(12) United States Patent
Pakyari et al.

(10) Patent No.: US 11,723,950 B2
(45) Date of Patent: Aug. 15, 2023

(54) CAL-T CONSTRUCTS AND USES THEREOF

(71) Applicants: TRUSTEES OF BOSTON UNIVERSITY, Boston, MA (US); THE GENERAL HOSPITAL CORPORATION, Boston, MA (US)

(72) Inventors: Mohammadreza Pakyari, Brookline, MA (US); Wilson Wong, Brookline, MA (US); Atsushi Okuma, Kagawa (JP); Curtis Cetrulo, Cohasset, MA (US)

(73) Assignees: TRUSTEES OF BOSTON UNIVERSITY, Boston, MA (US); THE GENERAL HOSPITAL CORPORATION, Boston, MA (US)

(*) Notice: Subject to any disclaimer, the term of this patent is extended or adjusted under 35 U.S.C. 154(b) by 0 days.

(21) Appl. No.: 17/072,490

(22) Filed: Oct. 16, 2020

(65) Prior Publication Data
US 2021/0113653 A1    Apr. 22, 2021

Related U.S. Application Data
(60) Provisional application No. 62/916,924, filed on Oct. 18, 2019.

(51) Int. Cl.
| | | |
|---|---|---|
| *A61K 35/17* | (2015.01) | |
| *A61K 38/17* | (2006.01) | |
| *A61K 39/44* | (2006.01) | |
| *C12N 5/0783* | (2010.01) | |
| *C07K 14/725* | (2006.01) | |
| *C07K 14/47* | (2006.01) | |
| *A61K 38/16* | (2006.01) | |
| *C12N 15/10* | (2006.01) | |

(52) U.S. Cl.
CPC .......... *A61K 38/16* (2013.01); *C07K 14/7051* (2013.01); *C12N 15/102* (2013.01); *C07K 2319/02* (2013.01); *C07K 2319/73* (2013.01); *C07K 2319/81* (2013.01)

(58) Field of Classification Search
CPC .... A61K 38/16; C12N 15/02; C07K 14/7051; C07K 2319/02
See application file for complete search history.

(56) References Cited

U.S. PATENT DOCUMENTS

| | | |
|---|---|---|
| 2014/0134142 A1 | 5/2014 | Smith et al. |
| 2018/0346541 A1 | 12/2018 | Wong et al. |

FOREIGN PATENT DOCUMENTS

| | | |
|---|---|---|
| AU | 2013312838 B2 | 11/2018 |
| CA | 2950763 A1 | 12/2015 |
| CN | 109414428 A | 3/2019 |
| WO | 2018204717 A1 | 11/2018 |
| WO | 2019099440 A1 | 5/2019 |
| WO | WO-2019099440 A1 * | 5/2019 ......... A61K 38/1774 |

OTHER PUBLICATIONS

Allez et al., "CD4+NKG2D+ T Cells in Crohn's Disease Mediate Inflammatory and Cytotoxic Responses Through MICA Interactions", 2007, Gastroenterology 132, p. 2346-2358.*
Calcedo et al., "Assessment of Humoral, Innate, and T-Cell Immune Responses to Adeno-Associated Virus Vectors", Apr. 1, 2018, Human Gene Therapy Methods 29(2), p. 86-95.*
Perfetto et al., "Seventeen-colour flow cytometry: unravelling the immune system", 2004, Nature Reviews Immunology 4, p. 648-655.*
Sergeeva et al., "An anti-PR1/HLA-A2 T-cell receptor-like antibody mediates complement-dependent cytotoxicity against acute myeloid leukemia progenitor cells", 2011, Blood 117(16), p. 4262-4272.*
Zhao et al., "Universal CARs, universal T cells, and universal CAR T cells", Nov. 27, 2018, Journal of Hematology and Oncology 11, p. 1-9.*
La Gruta NL, Gras S, Daley SR, Thomas PG, Rossjohn J. Understanding the drivers of MHC restriction of T cell receptors. Nature Reviews Immunology. Jul. 2018;18(7):467-78. (Year: 2018).*
Itakura A, Aslan JE, Sinha S, White-Adams TC, Patel IA, Meza-Romero R, Vandenbark AA, Burrows GG, Offner H, McCarty OJ. Characterization of human platelet binding of recombinant T cell receptor ligand. Journal of neuroinflammation. Dec. 2010;7(1):1-9. (Year: 2010).*
Ma, Crystal Wai Yin. "The Development of Immunoreagents to Detect for a Cellular Immune Response." Master's thesis, Veterinary Medicine, Available Aug. 22, 2019; https://prism.ucalgary.ca/handle/1880/110759. (Year: 2019).*
Davis MM, Altman JD, Newell EW. Interrogating the repertoire: broadening the scope of peptide-MHC multimer analysis. Nature Reviews Immunology. Aug. 2011;11(8):551-8. (Year: 2011).*
Samanta D, Mukherjee G, Ramagopal UA, Chaparro RJ, Nathenson SG, DiLorenzo TP, Almo SC. Structural and functional characterization of a single-chain peptide-MHC molecule that modulates both naive and activated CD8+ T cells. Proceedings of the National Academy of Sciences. Aug. 16, 2011; 108(33):13682-7. (Year: 2011).*
Wooldridge L, Lissina A, Cole DK, Van Den Berg HA, Price DA, Sewell AK. Tricks with tetramers: how to get the most from multimeric peptide-MHC. Immunology. Feb. 2009;126(2):147-64. (Year: 2009).*

(Continued)

*Primary Examiner* — Maria Marvich
(74) *Attorney, Agent, or Firm* — Nixon Peabody LLP; Ronald I. Eisenstein; Nicole D. Kling

(57) ABSTRACT

The technology described herein is directed to compositions comprising components of multi-component CALs or CARs, e.g., a TCR recognition domain; and one or both of: (a) an intracellular signaling domain; and (b) a first-type protein interaction domain. Further provided herein are methods for treating or preventing an autoimmune disease, a transplant rejection, or graft versus host disease.

17 Claims, 29 Drawing Sheets

Specification includes a Sequence Listing.

(56) References Cited

OTHER PUBLICATIONS

Lee YG, Marks I, Srinivasarao M, Kanduluru AK, Mahalingam SM, Liu X, Chu H, Low PS. Use of a single CAR T cell and several bispecific adapters facilitates eradication of multiple antigenically different solid tumors. Cancer research. Jan. 15, 2019;79(2):387-96. (Year: 2019).*

Calcedo et al., "Assessment of Humoral, Innate, and T-Cell Immune Responses to Adeno-Associated Virus Vectors", Apr. 1, 2018, Human Gene Therapy Methods 29(2), p. 86-95. (Year: 2018).*

Sackstein R, Schatton T, Barthel SR. T-lymphocyte homing: an underappreciated yet critical hurdle for successful cancer immunotherapy. Laboratory investigation. Jun. 2017;97(6):669-97. (Year: 2017).*

Schmidt J, Dojcinovic D, Guillaume P, Luescher I. Analysis, Isolation, and Activation of Antigen-Specific CD4(+) and CD8(+) T Cells by Soluble MHC-Peptide Complexes. Front Immunol. 2013;4:218. Published Jul. 30, 2013. doi:10.3389/fimmu.2013.00218 (Year: 2013).*

Kappel BJ, Pinilla-Ibarz J, Kochman AA, Eng JM, Hubbard VM, Leiner I, Pamer EG, Heller G, van den Brink MR, Scheinberg DA. Remodeling specific immunity by use of MHC tetramers: demonstration in a graft-versus-host disease model. Blood. Mar. 1, 2006; 107(5):2045-51 (Year: 2006).*

Gojanovich GS, Hess PR. Making the most of major histocompatibility complex molecule multimers: applications in Type 1 diabetes. Clinical and Developmental Immunology. Jan. 1, 2012;2012 (Year: 2012).*

Zhao et al, Universal CARs, universal T cells, and universal CAR T cells, Journal of Hematology & Oncology (2018) 11:132, pp. 1-9.*

Maldini et al, Car T cells for infection, autoimmunity and allotransplantation, Nat Rev Immunol. Oct. 2018 ; 18(10): 605-616.*

Bao et al, Engineered T cells and their therapeutic applications in autoimmune diseases, Zool. Res. 2022, 43(2): 150-165.*

LeBrec et al, Nonclinical safety assessment of engineered T cell therapies, Regulatory Toxicology and Pharmacology 127 (2021) pp. 1-8.*

Depil et al, 'Off-the-shelf' allogeneic CAR T cells: development and challenges, NaTure Reviews | Drug Discovery, 2020, pp. 185-199.*

Bonifant et al. "Toxicity and management in CAR T-cell therapy." Molecular Therapy—Oncolytics 3: 16011 pp. 1-7 (2016).

Leonard et al. "Vascularized composite allograft tolerance across MHC barriers in a large animal model." American Journal of Transplantation 14(2): 343-355 (2014).

Yigiter et al. "Demography and function of children with limb loss." Prosthetics and Orthotics International 29(2): 131-138 (2005).

Valujskikh. "The challenge of inhibiting alloreactive T-cell memory." American Journal of Transplantation 6(4): 647-651 (2006).

Nadazdin et al. "Host alloreactive memory T cells influence tolerance to kidney allografts in nonhuman primates." Science Translational Medicine 3(86): 86ra51 pp. 1-14 (2011).

\* cited by examiner

|  | OT i | | | | | | OT ii | | | | | |
| --- | --- | --- | --- | --- | --- | --- | --- | --- | --- | --- | --- | --- |
|  | 1 | 2 | 3 | 4 | 5 | 6 | 7 | 8 | 9 | 10 | 11 | 12 |
|  | 50 (A) | 50 (A) | 50 (A) | 50 (C) | 50 (C) | 50 (C) | 50 (B) | 50 (B) | 50 (B) | 50 (C) | 50 (C) | 50 (C) |
|  | 25 (A) | 25 (A) | 25 (A) | 25 (C) | 25 (C) | 25 (C) | 25 (B) | 25 (B) | 25 (B) | 25 (C) | 25 (C) | 25 (C) |
|  | 12.5 | 12.5 | 12.5 | 12.5 | 12.5 | 12.5 | 12.5 | 12.5 | 12.5 | 12.5 | 12.5 | 12.5 |
|  | 6.25 | 6.25 | 6.25 | 6.25 | 6.25 | 6.25 | 6.25 | 6.25 | 6.25 | 6.25 | 6.25 | 6.25 |
|  | 3.1 | 3.1 | 3.1 | 3.1 | 3.1 | 3.1 | 3.1 | 3.1 | 3.1 | 3.1 | 3.1 | 3.1 |
|  | 1.5 | 1.5 | 1.5 | 1.5 | 1.5 | 1.5 | 1.5 | 1.5 | 1.5 | 1.5 | 1.5 | 1.5 |
|  | 0.73 | 0.73 | 0.73 | 0.73 | 0.73 | 0.73 | 0.73 | 0.73 | 0.73 | 0.73 | 0.73 | 0.73 |
|  | 0 | 0 | 0 | 0 | 0 | 0 | 0 | 0 | 0 | 0 | 0 | 0 |

A: H2Kb-SIINFEKL (for OT-I)
B: I-Ab-HAEINEA (for OT-II)
C: I-Ab-PVSKMR... (negative control)

anti-mouse CD8-PerCP-Cy5.5 (for OT-I).
anti-mouse CD107a-APC — 4 hr
anti-human CD69-APC — 24hr
anti-mouse CD69-APC

Fig. 11

|  | OT i | | | | | | OT ii | | | | | |
|---|---|---|---|---|---|---|---|---|---|---|---|---|
|  | 1 | 2 | 3 | 4 | 5 | 6 | 7 | 8 | 9 | 10 | 11 | 12 |
|  | 200 (A) | 200 (A) | 200 (A) | 200 (C) | 200 (C) | 200 (C) | 1000 (B) | 1000 (B) | 1000 (B) | 1000 (C) | 1000 (C) | 1000 (C) |
|  | 50 (A) | 50 (A) | 50 (A) | 50 (C) | 50 (C) | 50 (C) | 250 (B) | 250 (B) | 250 (B) | 250 (C) | 250 (C) | 250 (C) |
|  | 12.5 | 12.5 | 12.5 | 12.5 | 12.5 | 12.5 | 62.5 | 62.5 | 62.5 | 62.5 | 62.5 | 62.5 |
|  | 3.1 | 3.1 | 3.1 | 3.1 | 3.1 | 3.1 | 15.6 | 15.6 | 15.6 | 15.6 | 15.6 | 15.6 |
|  | 0.73 | 0.73 | 0.73 | 0.73 | 0.73 | 0.73 | 3.9 | 3.9 | 3.9 | 3.9 | 3.9 | 3.9 |
|  | 0 | 0 | 0 | 0 | 0 | 0 | 0 | 0 | 0 | 0 | 0 | 0 |
|  | 200 (A) | 200 (A) | 200 (A) | 200 (C) | 200 (C) | 200 (C) | 1000 (B) | 1000 (B) | 1000 (B) | 1000 (C) | 1000 (C) | 1000 (C) |
|  | CD8-FITC | CD8-FITC | CD8-FITC | CD4-FITC | CD4-FITC | CD4-FITC | CD8-FITC | CD8-FITC | CD8-FITC | CD4-FITC | CD4-FITC | CD4-FITC |

Fig. 17

CAL-T CONSTRUCTS AND USES THEREOF

CROSS-REFERENCE TO RELATED APPLICATIONS

This application claims benefit under 35 U.S.C. § 119(e) of U.S. Provisional Application No. 62/916,924 filed Oct. 18, 2019, the contents of which are incorporated herein by reference in their entirety.

SEQUENCE LISTING

The instant application contains a Sequence Listing which has been submitted electronically in ASCII format and is hereby incorporated by reference in its entirety. Said ASCII copy, created on Oct. 16, 2020, is named 701586-096030USPT_SL.txt and is 540,018 bytes in size.

TECHNICAL FIELD

The technology described herein relates to chimeric antigen ligand (CAL) technology, e.g., for treating of autoimmune and/or T-cell mediated conditions.

BACKGROUND

The major cause of autoimmunity and transplant rejection, e.g., following an organ transplant, is autoreactive and alloreactive T cells attacking the patient's or donor's organ(s), tissue, and/or cells. Current treatments for preventing autoimmunity and transplant rejection involve stringent immunosuppression, which can lead to severe, unwanted side effects including extreme susceptibility to infection, malignant and benign neoplasms, multiple organ and systems failure. In order to prevent autoimmunity and transplant rejection without inducing unwanted side effects, it would be advantageous to delete autoreactive and alloreactive T cells in a patient receiving an organ transplant without needing to additionally administer immunosuppressant medications, or to reduce the doses of the immunosuppressant regime delivered concurrently. This type of therapy, however, has not been successfully demonstrated.

T cells recognize their target cells by using receptors on their cell surface which are called T Cell Receptors (TCRs). TCRs have a recognition portion and a signaling portion. When the recognition portion binds to the natural complexes formed in the body in the presence of a diseased cell, the signaling portion is activated, which leads to the T cell engaging in killing activity or recruiting other immune cells to destroy the diseased cell. The natural complexes are also known as peptide-major histocompatibility complexes (pMHC complexes). CAR-T cell therapy is known and seeks to help T cells recognize autoreactive and alloreactive T cells. This is accomplished by genetically altering a T cell so that it expresses a chimeric antigen receptor (CAR). The CAR is an altered TCR, in which the natural recognition portion is removed and replaced with a synthetic recognition portion that is designed to more effectively recognize the autoreactive and alloreactive T cells by very specifically detecting the presence of a molecule unique to the autoreactive and alloreactive T cells. These CAR-T cells are then given to a patient. Inside the patient, their synthetic CAR molecules will bind to the autoreactive and alloreactive T cells and in the act of that binding, activate the T cell, resulting in the patient's own immune system attacking the diseased T-cells.

SUMMARY

Described herein are methods and compositions relating to chimeric antigen ligands (CAL). The CALs described herein comprise a TCR recognition domain and a biomolecular interaction domain. The TCR recognition permits the CAL to bind to autoreactive and/or alloreactive T cells in an antigen specific manner. The biomolecular interaction domain permits an immune killer cell (e.g., a NK cell, a T cell, or a dendritic cell) to bind to the CAL, thereby promoting killing of the autoreactive and/or alloreactive T cell by the immune killer cell.

The TCR recognition domain of a CAL binds specifically to a TCR, e.g., a TCR expressed on the surface of an autoreactive and/or alloreactive T cell. Exemplary but non-limiting TCR recognition domains include peptide-MHC complexes, e.g., in monomeric, oligomeric, or multimeric form. The TCR recognition domain can comprise natural or synthetic sequences. Specific examples of peptide-MHC complexes that include autoreactive or alloreactive antigens are provided elsewhere herein.

The biomolecular interaction domain of the CAL permits specific binding of the CAL with a second biomolecule, e.g., a receptor on the immune killer cell. In some embodiments, the biomolecular interaction domain of the CAL is recognized by an endogenous receptor on the immune killer cell. In some embodiments, the biomolecular interaction domain of the CAL is recognized by an engineered receptor on the immune killer cell. Exemplary but non-limiting biomolecular interaction domains include FITC (which can be recognized by a FITC CAR-T cell system), a leucine zipper domain, a zinc finger domain, PSD95-Dlg1-zo-1 (PDZ) domains, a streptavidin domain and a streptavidin binding protein (SBP) domain, a gibberellin insensitive (GIA) and/or a gibberellin insensitive dwarf1 (GID1), a PYL domain and an ABI domain, a chemically-induced pair of interaction domains as described elsewhere herein, a Snap-tag, a Halo tag, a T14-3-3-cdeltaC and/or a C-Terminal peptide of PMA2 (CT52), a (R)-Phycoerythrin (R-PE/PE) and/or a R-PE/PE binding protein a Fab domain, and/or an anti-CD3 domain.

As noted, the CALs described herein can be used in combination with CAR-T systems. Exemplary but non-limiting CAR-T systems suitable for use with the methods and compositions described herein include SUPRA CAR and SPLIT CAR. CAR-T systems are discussed in more detail elsewhere herein and are known in the art.

In one aspect of any of the embodiments, described herein is a composition, comprising: a) a TCR recognition domain; and one or both of: b) an intracellular signaling domain; and c) a biomolecular interaction domain (e.g., a first-type biomolecular interaction domain).

In one aspect of any of the embodiments, described herein is a composition comprising: a first polypeptide comprising at least a portion of a TCR recognition domain and a first-type biomolecular interaction domain; and a signaling polypeptide comprising a second-type biomolecular interaction domain and an intracellular signaling domain; wherein the first-type and second-type biomolecular interaction domains bind specifically to each other. In one aspect of any of the embodiments, described herein is a composition comprising: a first polypeptide comprising at least a portion of a TCR recognition domain and a first-type biomolecular interaction domain; and a recognition polypeptide comprising a second recognition domain and a third-type biomolecular interaction domain; wherein the first-type and third-type biomolecular interaction domains bind specifically to each other. In one aspect of any of the embodiments, described herein is a composition comprising: a first polypeptide comprising at least a portion of a TCR recognition domain and a first-type biomolecular interaction domain; and a signaling polypeptide comprising a second-type biomolecular interaction domain and an intracellular signaling domain; and a recognition polypeptide comprising a second recognition domain and a third-type biomolecular interaction domain; wherein the second-type and third-type biomolecular interaction domains compete for binding to the first-type biomolecular interaction domain. In some embodiments of any of the aspects, the third-type biomolecular interaction domain and first-type biomolecular interaction domain have a higher affinity for each other than the second-type biomolecular interaction domain and first-type biomolecular interaction domain.

In one aspect of any of the embodiments, described herein is a composition comprising: a first polypeptide comprising at least a portion of a TCR recognition domain and a first-type biomolecular interaction domain; a signaling polypeptide comprising a second-type biomolecular interaction domain, a fourth-type biomolecular interaction domain, and an intracellular signaling domain; and a recognition polypeptide comprising a second recognition domain and a fifth-type biomolecular interaction domain; wherein the first-type biomolecular interaction domain and the second-type biomolecular interaction domain bind specifically to each other; and wherein the fourth-type biomolecular interaction domain and the fifth-type biomolecular interaction domain bind specifically to each other. In some embodiments of any of the aspects, the fourth-type biomolecular interaction domain and fifth-type biomolecular interaction domain have a weaker affinity than the second-type biomolecular interaction domain and first-type protein interaction domain. In some embodiments of any of the aspects, the first polypeptide further comprises a sixth-type biomolecular interaction domain and the recognition polypeptide further comprises a seventh-type biomolecular interaction domain which bind specifically to each other.

In some embodiments of any of the aspects, the first polypeptide comprises the entire TCR recognition domain. In some embodiments of any of the aspects, the TCR recognition domain comprises at least two separate polypeptide sequences, the first polypeptide comprises at least one of the separate polypeptide sequences of the TCR recognition domain, and the first polypeptide is bound to or complexed with a second or further polypeptide sequences of the TCR recognition domain to form a TCR recognition domain. In some embodiments of any of the aspects, the TCR recognition domain comprises a non-polypeptide component.

In some embodiments of any of the aspects, the second recognition domain is specific for a target that is not recognized by the TCR recognition domain. In some embodiments of any of the aspects, the second recognition domain is specific for a target that is found on a healthy and/or non-target cell and not on a diseased and/or target cell.

In some embodiments of any of the aspects, the TCR recognition domain comprises a MHC (Major Histocompatibility Complex); a MHC-peptide complex; featureless peptide MHC; or a MHC-peptide fusion. In some embodiments of any of the aspects, the peptide is a human or non-human peptide. In some embodiments of any of the aspects, the peptide is a Minor Histocompatibility Antigen (MiHA). In some embodiments of any of the aspects, the MHC is a monomer, dimer, trimer, tetramer, pentamer, dextramer or other oligomer form. In some embodiments of any of the aspects, the MHC-peptide complex is a monomer, dimer, trimer, tetramer, pentamer, dextramer or other oligomer form. In some embodiments of any of the aspects, the MHC-peptide fusion is a monomer, dimer, trimer, tetramer, pentamer, dextramer or other oligomer form. In some embodiments of any of the aspects, the MHC is a dimer, trimer, tetramer, pentamer, dextramer or other oligomer form. In some embodiments of any of the aspects, the MHC-peptide complex is a dimer, trimer, tetramer, pentamer, dextramer or other oligomer form. In some embodiments of any of the aspects, the MHC-peptide fusion is a dimer, trimer, tetramer, pentamer, dextramer or other oligomer form. In some embodiments of any of the aspects, the MHC is a MHC class I or a MHC class II.

In some embodiments of any of the aspects, the TCR recognition domain comprises a CD1 domain or a CD1 domain-ligand complex or fusion. In some embodiments of any of the aspects, the CD1 is CD1d.

In some embodiments of any of the aspects, the biomolecular interaction domains are found on an extracellular portion of the respective polypeptides. In some embodiments of any of the aspects, a. wherein the biomolecular interaction domain(s) is a leucine zipper, or any binding pair of biomolecular interaction domains are collectively a pair of leucine zippers;
b. wherein the biomolecular interaction domain(s) is a BZip (RR) and/or a AZip (EE), or any binding pair of biomolecular interaction domains are collectively a BZip (RR) and a AZip (EE);
c. wherein the biomolecular interaction domain(s) is a PSD95-Dlg1-zo-1 (PDZ) domain;
d. wherein the biomolecular interaction domain(s) is a streptavidin and/or a streptavidin binding biomolecular (SBP) or any binding pair of biomolecular interaction domains are collectively a streptavidin and a streptavidin binding biomolecular (SBP);
e. wherein the biomolecular interaction domain(s) is a FKBP-binding domain of mTOR (FRB) and/or a FK506 binding biomolecular (FKBP) or any binding pair of biomolecular interaction domains are collectively a FKBP-binding domain of mTOR (FRB) and a FK506 binding biomolecular (FKBP);
f. wherein the biomolecular interaction domain(s) is a cyclophilin-Fas fusion biomolecular (CyP-Fas) and/or a FK506 binding biomolecular (FKBP) or any binding pair of biomolecular interaction domains are collectively a cyclophilin-Fas fusion biomolecular (CyP-Fas) and a FK506 binding biomolecular (FKBP);
g. wherein the biomolecular interaction domain(s) is a calcineurin A (CNA) and/or a FK506 binding biomolecular (FKBP) or any binding pair of biomolecular interaction domains are collectively a calcineurin A (CNA) and a FK506 binding biomolecular (FKBP);
h. wherein the biomolecular interaction domain(s) is a gibberellin insensitive (GIA) and/or a gibberellin insensitive dwarf1 (GID1) or any binding pair of biomolecular interaction domains are collectively a gibberellin insensitive (GIA) and a gibberellin insensitive dwarf1 (GID1);
i. wherein the biomolecular interaction domain(s) is a Snap-tag and/or a Halo tag, or any binding pair of biomolecular interaction domains are collectively a Snap-tag and a Halo tag;
j. wherein the biomolecular interaction domain(s) is a T14-3-3-cdeltaC and/or a C-Terminal peptides of PMA2 (CT52), or any binding pair of biomolecular interaction domains are collectively a T14-3-3-cdeltaC and a C-Terminal peptides of PMA2 (CT52);
k. wherein the biomolecular interaction domain(s) is a PYL and/or a ABI, or any binding pair of biomolecular interaction domains are collectively a PYL and a ABI;
l. wherein the biomolecular interaction domain(s) is a nucleotide tag and/or a zinc finger domain, or any binding pair of biomolecular interaction domains are collectively a nucleotide tag and a zinc finger domain;
m. wherein the biomolecular interaction domain(s) is a nucleotide tag, or any binding pair of biomolecular interaction domains are collectively a pair of nucleotide tags;
n. wherein the biomolecular interaction domain(s) is a Fluorescein isothiocyanate (FITC) and/or a FITC binding biomolecular or any binding pair of protein interaction domains are collectively a FITC and a FITC binding protein; and/or
o. wherein the protein interaction domain(s) is a (R)-Phycoerythrin (R-PE/PE) and/or a R-PE/PE binding protein or any binding pair of protein interaction domains are collectively a (R)-Phycoerythrin (R-PE/PE) and a R-PE/PE binding protein.

In some embodiments of any of the aspects, the nucleotide tag is a DNA tag or dsDNA tag.

In some embodiments of any of the aspects, the intracellular signaling domain comprises or is a signaling domain from one or more proteins selected from the group consisting of: TCRζ, FcRγ, FcRβ, CD3γ; CD35; CD3λ; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; and ZAP70.

In one aspect of any of the embodiments, described herein is a cell comprising and/or expressing a composition described herein. In one aspect of any of the embodiments, described herein is a composition comprising a first polypeptide of any of the preceding claims and a cell expressing or comprising the signaling polypeptide of any of the preceding claims.

In some embodiments of any of the aspects, the TCR recognition domain comprises a MHC allogeneic, autologous, or xenogeneic to the cell. In some embodiments of any of the aspects, the TCR recognition domain comprises a synthetic MHC. In some embodiments of any of the aspects, the TCR recognition domain comprises a MHC and a peptide, wherein the peptide is allogeneic, autologous, or xenogeneic to the cell. In some embodiments of any of the aspects, the TCR recognition domain comprises a MHC and a peptide, wherein the peptide is synthetic.

In some embodiments of any of the aspects, the cell is a NK cell, dendritic cell, regulatory T cell, or effector T cell. In some embodiments of any of the aspects, the cell is engineered to express one of more of the polypeptide(s) of the composition. In some embodiments of any of the aspects, the cell is engineered to express the signaling polypeptide of the composition. In some embodiments of any of the aspects, the cell is further engineered to knockout or knockdown the native MHCI/II. In some embodiments of any of the aspects, the cell is further engineered to knockdown the native MHCI/II expressed on the cell surface.

In one aspect of any of the embodiments, described herein is a composition, comprising a TCR recognition domain and an intracellular signaling domain but not comprising a biomolecular interaction domain (e.g., a first-type biomolecular interaction domain). In one aspect of any of the embodiments, described herein is a composition, comprising a TCR recognition domain and a biomolecular interaction domain (e.g., a first-type biomolecular interaction domain) and but not comprising an intracellular signaling domain.

In one aspect of any of the embodiments, described herein is a method of treating or preventing an autoimmune disease or condition; T cell mediated inflammation or immune response; malignant T cell condition; transplant rejection; or GvHD in a subject in need thereof, the method comprising administering to the subject a composition and/or cell of any of the preceding claims. In some embodiments of any of the aspects, the TCR recognition domain comprises a MHC allogeneic to the subject.

In some embodiments of any of the aspects, the TCR recognition domain comprises a MHC autologous to the transplant cells. In some embodiments of any of the aspects, the TCR recognition domain comprises a MHC xenogeneic to the transplant cells. In some embodiments of any of the aspects, the TCR recognition domain comprises a MHC and a peptide, wherein the peptide is allogeneic to the subject. In some embodiments of any of the aspects, the TCR recognition domain comprises a MHC and a peptide, wherein the peptide is autologous to the transplant cells. In some embodiments of any of the aspects, the TCR recognition domain comprises a MHC and a peptide, wherein the peptide is autologous to the transplant cells. In some embodiments of any of the aspects, the transplant is any human or non-human cell, tissue, or organ. In some embodiments of any of the aspects, the transplant is an allogeneic hematopoietic stem cell or solid organ transplantation.

In some embodiments of any of the aspects, the malignant T cell condition is T cell acute lymphoblastic leukemia or T cell lymphoblastic lymphoma.

In some embodiments of any of the aspects, the autoimmune disease is type 1 diabetes, vitiligo, multiple sclerosis, alopecia, celiac disease, pemphigus, rheumatoid arthritis, or scleroderma. In some embodiments of any of the aspects, the autoimmune disease is thyroiditis, type 1 diabetes mellitus, Hashimoto's thyroiditis, Graves' disease, celiac disease, multiple sclerosis, Guillain-Barre syndrome, Addison's disease, and Raynaud's phenomenon, Goodpasture's disease, arthritis (rheumatoid arthritis such as acute arthritis, chronic rheumatoid arthritis, gout or gouty arthritis, acute gouty arthritis, acute immunological arthritis, chronic inflammatory arthritis, degenerative arthritis, type II collagen-induced arthritis, infectious arthritis, Lyme arthritis (e.g., post treatment Lyme disease syndrome), proliferative arthritis, psoriatic arthritis, Still's disease, vertebral arthritis, and juvenile-onset rheumatoid arthritis, arthritis chronica progrediente, arthritis deformans, polyarthritis chronica primaria, reactive arthritis, and ankylosing spondylitis), palindromic arthritis, inflammatory hyperproliferative skin diseases, psoriasis such as plaque psoriasis, guttate psoriasis, pustular psoriasis, and psoriasis of the nails, atopy including atopic diseases such as hay fever and Job's syndrome, dermatitis including contact dermatitis, chronic contact dermatitis, exfoliative dermatitis, allergic dermatitis, allergic contact dermatitis, dermatitis herpetiformis, nummular dermatitis, seborrheic dermatitis, non-specific dermatitis, primary irritant contact dermatitis, and atopic dermatitis, x-linked hyper IgM syndrome, allergic intraocular inflammatory diseases, urticaria such as chronic allergic urticaria and chronic idiopathic urticaria, including chronic autoimmune urticaria, myositis, polymyositis/dermatomyositis, juvenile dermatomyositis, toxic epidermal necrolysis, scleroderma (including systemic scleroderma), sclerosis such as systemic sclerosis, multiple sclerosis (MS) such as spino-optical MS, primary progressive MS (PPMS), and relapsing remitting MS (RRMS), progressive systemic sclerosis, atherosclerosis, arteriosclerosis, sclerosis disseminata, ataxic sclerosis, neuromyelitis optica (NMO), inflammatory bowel disease (IBD) (for example, Crohn's disease, autoimmune-mediated gastrointestinal diseases, colitis such as ulcerative colitis, colitis ulcerosa, microscopic colitis, collagenous colitis, colitis polyposa, necrotizing enterocolitis, and transmural colitis, and autoimmune inflammatory bowel disease), bowel inflammation, pyoderma gangrenosum, erythema nodosum, primary sclerosing cholangitis, respiratory distress syndrome, including adult or acute respiratory distress syndrome (ARDS), meningitis, inflammation of all or part of the uvea, iritis, choroiditis, an autoimmune hematological disorder, rheumatoid spondylitis, rheumatoid synovitis, hereditary angioedema, cranial nerve damage as in meningitis, herpes gestationis, pemphigoid gestationis, pruritis scroti, autoimmune premature ovarian failure, sudden hearing loss due to an autoimmune condition, IgE-mediated diseases such as anaphylaxis and allergic and atopic rhinitis, encephalitis such as Rasmussen's encephalitis and limbic and/or brainstem encephalitis, uveitis, such as anterior uveitis, acute anterior uveitis, granulomatous uveitis, nongranulomatous uveitis, phacoantigenic uveitis, posterior uveitis, or autoimmune uveitis, glomerulonephritis (GN) with and without nephrotic syndrome such as chronic or acute glomerulonephritis such as primary GN, immune-mediated GN, membranous GN (membranous nephropathy), idiopathic membranous GN or idiopathic membranous nephropathy, membrano- or membranous proliferative GN (MPGN), including Type I and Type II, and rapidly progressive GN, proliferative nephritis, autoimmune polyglandular endocrine failure, balanitis including balanitis circumscripta plasmacellularis, balanoposthitis, erythema annulare centrifugum, erythema dyschromicum perstans, eythema multiform, granuloma annulare, lichen nitidus, lichen sclerosus et atrophicus, lichen simplex chronicus, lichen spinulosus, lichen planus, lamellar ichthyosis, epidermolytic hyperkeratosis, premalignant keratosis, pyoderma gangrenosum, allergic conditions and responses, allergic reaction, eczema including allergic or atopic eczema, asteatotic eczema, dyshidrotic eczema, and vesicular palmoplantar eczema, asthma such as asthma bronchiale, bronchial asthma, and auto-immune asthma, conditions involving infiltration of T cells and chronic inflammatory responses, immune reactions against foreign antigens such as fetal A-B-O blood groups during pregnancy, chronic pulmonary inflammatory disease, autoimmune myocarditis, leukocyte adhesion deficiency, lupus, including lupus nephritis, lupus cerebritis, pediatric lupus, non-renal lupus, extra-renal lupus, discoid lupus and discoid lupus erythematosus, alopecia lupus, systemic lupus erythematosus (SLE) such as cutaneous SLE or subacute cutaneous SLE, neonatal lupus syndrome (NLE), and lupus erythematosus disseminatus, juvenile onset (Type I) diabetes mellitus, including pediatric insulin-dependent diabetes mellitus (IDDM), adult onset diabetes mellitus (Type II diabetes), autoimmune diabetes, idiopathic diabetes insipidus, diabetic retinopathy, diabetic nephropathy, diabetic large-artery disorder, immune responses associated with acute and delayed hypersensitivity mediated by cytokines and T-lymphocytes, sarcoidosis, granulomatosis including lymphomatoid granulomatosis, Wegener's granulomatosis, agranulocytosis, vasculitides, including vasculitis, large-vessel vasculitis (including polymyalgia rheumatica and giant-cell (Takayasu's) arteritis), medium-vessel vasculitis (including Kawasaki's disease and polyarteritis nodosa/periarteritis nodosa), microscopic polyarteritis, immunovasculitis, CNS vasculitis, cutaneous vasculitis, hypersensitivity vasculitis, necrotizing vasculitis such as systemic necrotizing vasculitis, and ANCA-associated vasculitis, such as Churg-Strauss vasculitis or syndrome (CSS) and ANCA-associated small-vessel vasculitis, temporal arteritis, autoimmune aplastic anemia, Coombs positive anemia, Diamond Blackfan anemia, hemolytic anemia or immune hemolytic anemia including autoimmune hemolytic anemia (AIHA), pernicious anemia (anemia perniciosa), Addison's disease, pure red cell anemia or aplasia (PRCA), Factor VIII deficiency, hemophilia A, autoimmune neutropenia, pancytopenia, leukopenia, diseases involving leukocyte diapedesis, CNS inflammatory disorders, multiple organ injury syndrome such as those secondary to septicemia, trauma or hemorrhage, antigen-antibody complex-mediated diseases, anti-glomerular basement membrane disease, anti-phospholipid antibody syndrome, allergic neuritis, Behcet's disease/syndrome, Castleman's syndrome, Goodpasture's syndrome, Reynaud's syndrome, Sjogren's syndrome, Stevens-Johnson syndrome, pemphigoid such as pemphigoid bullous and skin pemphigoid, pemphigus (including pemphigus vulgaris, pemphigus foliaceus, pemphigus mucus-membrane pemphigoid, and pemphigus erythematosus), autoimmune polyendocrinopathies, Reiter's disease or syndrome, an immune complex disorder such as immune complex nephritis, antibody-mediated nephritis, polyneuropathies, chronic neuropathy such as IgM polyneuropathies or IgM-mediated neuropathy, and autoimmune or immune-mediated thrombocytopenia such as idiopathic thrombocytopenic purpura (ITP) including chronic or acute ITP, scleritis such as idiopathic cerato-scleritis, episcleritis, autoimmune disease of the testis and ovary including autoimmune orchitis and oophoritis, primary hypothyroidism, hypoparathyroidism, autoimmune endocrine diseases including thyroiditis such as autoimmune thyroiditis, Hashimoto's disease, chronic thyroiditis (Hashimoto's thyroiditis), or subacute thyroiditis, idiopathic hypothyroidism, Grave's disease, polyglandular syndromes such as autoimmune polyglandular syndromes (or polyglandular endocrinopathy syndromes), paraneoplastic syndromes, including neurologic paraneoplastic syndromes such as Lambert-Eaton myasthenic syndrome or Eaton-Lambert syndrome, stiff-man or stiff-person syndrome, encephalomyelitis such as allergic encephalomyelitis or encephalomyelitis allergica and experimental allergic encephalomyelitis (EAE), myasthenia gravis such as thymoma-associated myasthenia gravis, cerebellar degeneration, neuromyotonia, opsoclonus or opsoclonus myoclonus syndrome (OMS), and sensory neuropathy, multifocal motor neuropathy, Sheehan's syndrome, autoimmune hepatitis, lupoid hepatitis, giant-cell hepatitis, autoimmune chronic active hepatitis, lymphoid interstitial pneumonitis (LIP), bronchiolitis obliterans (non-transplant) vs NSIP, Guillain-Barre syndrome, Berger's disease (IgA nephropathy), idiopathic IgA nephropathy, linear IgA dermatosis, acute febrile neutrophilic dermatosis, subcorneal pustular dermatosis, transient acantholytic dermatosis, cirrhosis such as primary biliary cirrhosis and pneumonocirrhosis, autoimmune enteropathy syndrome, Celiac or Coeliac disease, celiac sprue (gluten enteropathy), refractory sprue, idiopathic sprue, cryoglobulinemia, amylotrophic lateral sclerosis (ALS; Lou Gehrig's disease), coronary artery disease, autoimmune ear disease such as autoimmune inner ear disease (AIED), autoimmune hearing loss, polychondritis such as refractory or relapsed or relapsing polychondritis, pulmonary alveolar proteinosis, Cogan's syndrome/nonsyphilitic interstitial keratitis, Bell's palsy, Sweet's disease/syndrome, rosacea autoimmune, zoster-associated pain, amyloidosis, a non-cancerous lymphocytosis, a primary lymphocytosis, which includes monoclonal B cell lymphocytosis (e.g., benign monoclonal gammopathy and monoclonal gammopathy of undetermined significance, MGUS), peripheral neuropathy, paraneoplastic syndrome, channelopathies including channelopathies of the CNS, autism, inflammatory myopathy, focal or segmental or focal segmental glomerulosclerosis (FSGS), endocrine opthalmopathy, uveoretinitis, chorioretinitis, autoimmune hepatological disorder, fibromyalgia, multiple endocrine failure, Schmidt's syndrome, adrenalitis, gastric atrophy, presenile dementia, demyelinating diseases such as autoimmune demyelinating diseases and chronic inflammatory demyelinating polyneuropathy, Dressler's syndrome, alopecia areata, alopecia totalis, CREST syndrome (calcinosis, Raynaud's phenomenon, esophageal dysmotility, sclerodactyly, and telangiectasia), male and female autoimmune infertility, e.g., due to anti-spermatozoan antibodies, mixed connective tissue disease, Chagas' disease, rheumatic fever, recurrent abortion, farmer's lung, erythema multiforme, post-cardiotomy syndrome, Cushing's syndrome, bird-fancier's lung, allergic granulomatous angiitis, benign lymphocytic angiitis, Alport's syndrome, alveolitis such as allergic alveolitis and fibrosing alveolitis, interstitial lung disease, transfusion reaction, Sampter's syndrome, Caplan's syndrome, endocarditis, endomyocardial fibrosis, diffuse interstitial pulmonary fibrosis, interstitial lung fibrosis, pulmonary fibrosis, idiopathic pulmonary fibrosis, cystic fibrosis, endophthalmitis, erythema elevatum et diutinum, erythroblastosis fetalis, eosinophilic faciitis, Shulman's syndrome, Felty's syndrome, cyclitis such as chronic cyclitis, heterochronic cyclitis, iridocyclitis (acute or chronic), or Fuch's cyclitis, Henoch-Schonlein purpura, SCID, sepsis, endotoxemia, post-vaccination syndromes, Evan's syndrome, autoimmune gonadal failure, Sydenham's chorea, post-streptococcal nephritis, thromboangitis ubiterans, thyrotoxicosis, tabes dorsalis, chorioiditis, giant-cell polymyalgia, chronic hypersensitivity pneumonitis, keratoconjunctivitis sicca, idiopathic nephritic syndrome, minimal change nephropathy, benign familial and ischemia-reperfusion injury, transplant organ reperfusion, retinal autoimmunity, aphthae, aphthous stomatitis, arteriosclerotic disorders, aspermiogenesis, autoimmune hemolysis, Boeck's disease, enteritis allergica, erythema nodosum leprosum, idiopathic facial paralysis, chronic fatigue syndrome, febris rheumatica, Hamman-Rich's disease, sensoneural hearing loss, ileitis regionalis, leucopenia, transverse myelitis, primary idiopathic myxedema, ophthalmia symphatica, polyradiculitis acuta, pyoderma gangrenosum, acquired spenic atrophy, vitiligo, toxic-shock syndrome, conditions involving infiltration of T cells, leukocyte-adhesion deficiency, immune responses associated with acute and delayed hypersensitivity mediated by cytokines and T-lymphocytes, diseases involving leukocyte diapedesis, multiple organ injury syndrome, antigen-antibody complex-mediated diseases, antiglomerular basement membrane disease, allergic neuritis, autoimmune polyendocrinopathies, oophoritis, primary myxedema, autoimmune atrophic gastritis, rheumatic diseases, mixed connective tissue disease, nephrotic syndrome, insulitis, polyendocrine failure, autoimmune polyglandular syndrome type I, adult-onset idiopathic hypoparathyroidism (AOIH), myocarditis, nephrotic syndrome, primary sclerosing cholangitis, acute or chronic sinusitis, ethmoid, frontal, maxillary, or sphenoid sinusitis, an eosinophil-related disorder such as eosinophilia, pulmonary infiltration eosinophilia, eosinophilia-myalgia syndrome, Loffler's syndrome, chronic eosinophilic pneumonia, tropical pulmonary eosinophilia, granulomas containing eosinophils, seronegative spondyloarthritides, polyendocrine autoimmune disease, sclerosing cholangitis, sclera, episclera, Bruton's syndrome, transient hypogammaglobulinemia of infancy, Wiskott-Aldrich syndrome, ataxia telangiectasia syndrome, angiectasis, autoimmune disorders associated with collagen disease, rheumatism, allergic hypersensitivity disorders, glomerulonephritides, reperfusion injury, ischemic re-perfusion disorder, lymphomatous tracheobronchitis, inflammatory dermatoses, dermatoses with acute inflammatory components, and autoimmune uveoretinitis (AUR).

In some embodiments of any of the aspects, the T cell mediated immune response is an anti-drug specific response to a biologic, cell therapy, and/or gene therapy. In some embodiments of any of the aspects, the biologic, cell-therapy, or gene therapy is an adeno-associated virus (AAV) gene therapy, a genome editing agent, or enzyme replacement therapy.

In some embodiments of any of the aspects, the disease is type 1 diabetes and the TCR recognition domain comprises sequences with at least 80% or at least 95% sequence identity to: one or more of SEQ ID NOs: 8-17; HLA-A*0201 and at least one of SEQ ID NOs: 2013-2016 and 2031-2033; or HLA-A*02:01 and at least one of SEQ ID NOs: 20128-2129. In some embodiments of any of the aspects, the disease is vitiligo and the TCR recognition domain comprises sequences with at least 80% or at least 95% sequence identity to: SEQ ID NO: 18, 19, and one of 20-22; or comprises HLA-A*0201 and SEQ ID NO: 2018; or HLA-A*0301 and SEQ ID NO: 2019; or comprises HLA-A*2402 and SEQ ID NO: 2020; or HLA-A*0101 and SEQ ID NO: 2021. In some embodiments of any of the aspects, the method is a method of treating and/or preventing GvHD and the TCR recognition domain comprises sequences with at least 80% or at least 95% sequence identity to: HLA-A*0101 and at least one of SEQ ID NOs: 2034-2037; or HLA-B*0702 and SEQ ID NO: 2038; or HLA-B*0801 and SEQ ID NO: 2039. In some embodiments of any of the aspects, the disease is type 1 diabetes and the TCR recognition domain comprises one or more of SEQ ID NOs: 8-17; comprises HLA-A*0201 and at least one of SEQ ID NOs: 2013-2016 and 2031-2033; or comprises HLA-A*02:01 and at least one of SEQ ID NOs: 20128-2129. In some embodiments of any of the aspects, the disease is vitiligo and the TCR recognition domain comprises SEQ ID NO: 18, 19, and one of 20-22; or comprises HLA-A*0201 and SEQ ID NO: 2018; or comprises HLA-A*0301 and SEQ ID NO: 2019; or comprises HLA-A*2402 and SEQ ID NO: 2020; or comprises HLA-A*0101 and SEQ ID NO: 2021. In some embodiments of any of the aspects, the method is a method of treating and/or preventing GvHD and the TCR recognition domain comprises HLA-A*0101 and at least one of SEQ ID NOs: 2034-2037; or comprises HLA-B*0702 and SEQ ID NO: 2038; or comprises HLA-B*0801 and SEQ ID NO: 2039.

BRIEF DESCRIPTION OF THE DRAWINGS

FIG. 7A demonstrates that zipCAR activation is tunable through modulation of zipFv concentration, zipper affinity, scFv affinity, and zipCAR expression level in human primary CD4 T cells, as demonstrated by IFN-g production. FIG. 7B demonstrates that SUPRA CAR system, as applied to Universal CAL, can perform combination antigen detection to form AND gate logic in CD4 T cells. FIG. 7C demonstrates that xenograft animal tumor model shows tumor eradication (as demonstrated by luciferase photon flux given by the tumor cells) by the SUPRA CAR T cells. FIG. 7D demonstrates that SUPRA CARs as applied to Universal CAL can be used to control different cell types, such as CD4 and CD8 T cells, against two different antigens. CD69 expression (a T cell activation marker) is quantified with flow cytometry for CD4 and CD8 T cells. (From Cho, Collins, and Wong, Cell. 2018)

FIG. 11 depicts a table of experimental design. Figure discloses SEQ ID NOS 2750, 2756 and 2754, respectively, in order of appearance.

FIG. 17 depicts a table of experimental design.

FIG. 18 discloses SEQ ID NOS 2754, 2750, 2754 and 2750 from left to right. FIG. 19 discloses SEQ ID NOS 2754 and 2750, respectively, in order of appearance. FIG. 20 discloses SEQ ID NOS 2750, 2754, 2750 and 2754 from left to right.

DETAILED DESCRIPTION

Figure 1:
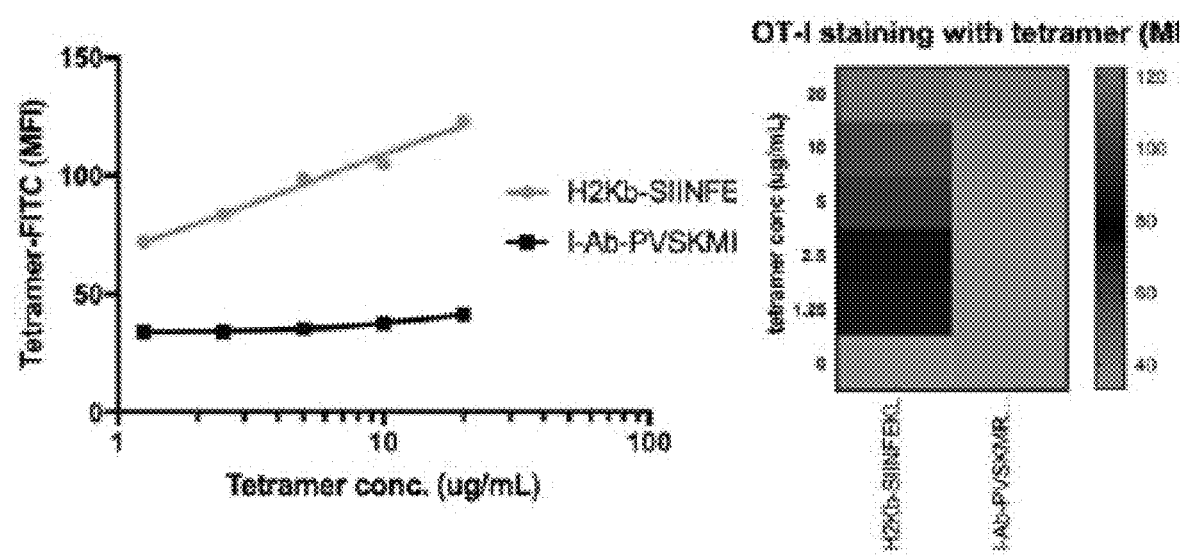
FIG. 1 demonstrates that pMHC tetramer+FITC (adaptor) binds to the target cells (OTi) in a dose dependent fashion or manner. I-H2Kb: MHC class I tetramer. I-Ab-: Control tetramer. Figure discloses SEQ ID NOS 2752-2753, 2750 and 2754, respectively, in order of appearance.

Aspects of the invention described herein relate to chimeric antigen ligands. As used herein, "chimeric antigen ligand" or "CAL" refers to an artificially constructed molecule comprising a TCR recognition domain (e.g. an polypeptide comprising at least one MHC sequence as described herein) and at least one biomolecular interaction domain. The TCR recognition domain is selected to bind to specific populations of T cells that it is desirable to target and/or destroy, e.g., for therapeutic purposes in T-cell mediated diseases. In some embodiments, the population of targeted T cells is a population of polyclonal pathogenic T cells. The biomolecular interaction domain is selected to bind to a second cell, e.g., a NK cell, thereby colocalizing the targeted T cell and the second cell and promoting or increasing the inhibition and/or destruction of the targeted T cell. In various embodiments, the CAL is selected to have high affinity or avidity for the TCR, e.g., the TCR variable domain.

The CALs can be used herein with endogenous cells, e.g., in some embodiments, no engineered cells are administered to the subject. In other embodiments, the CALs can be used with engineered cells, e.g., engineered NK cells. In such cases, the engineered cells can comprise one or more CARS, e.g, a CAR comprising an extracellular domain with a biomolecular interaction domain that specifically binds with the biomolecular interaction domain of the CAL.

Accordingly, described herein are chimeric antigen receptors (CARs) in which the recognition and signaling portions of the CAR are separate polypeptides. The two separate polypeptides that make up a complete CAR are able to interact and form the complete CAR by way of protein interaction domains. This permits flexible, modular CAR-T therapy which is capable of complex logic computation, providing a more precise and effective approach to immunotherapy.

In one aspect of any of the embodiments is a CAL and/or chimeric antigen receptor (CAR) having multiple components, and/or a cell or composition comprising a multi-component CAL and/or CAR. Multi-component CALs/CARs are also referred to herein variously as SMART CAL/CAR or SUPRA.

As used herein, traditional "chimeric antigen receptor" or "CAR" refers to an artificially constructed hybrid polypeptide comprising an antigen-binding domain (e.g. an antigen-binding portion of an antibody (e.g. a scFV)) linked to a cell signaling and/or cell activation domain. In some embodiments the cell-signaling domain can be a T-cell signaling domain. In some embodiments, the cell activation domain can be a T-cell activation domain. CARS have the ability to redirect the specificity and reactivity of T cells and other immune cells (e.g., NK cells) toward a selected target in a non-MHC-restricted manner, exploiting the antigen-binding properties of monoclonal antibodies.

The non-MHC-restricted antigen recognition gives T-cells expressing CARs the ability to recognize an antigen independent of antigen processing, thus bypassing a major mechanism of tumor escape. Moreover, when expressed in T-cells, CARS advantageously do not dimerize with endogenous T-cell receptor (TCR) alpha and beta chains. Most commonly, the CAR's extracellular binding domain is composed of a single chain variable fragment (scFv) derived from fusing the variable heavy and light regions of a murine or humanized monoclonal antibody. Alternatively, scFvs may be used that are derived from Fabs (instead of from an antibody, e.g., obtained from Fab libraries), in various embodiments, this scFv is fused to a transmembrane domain and then to an intracellular signaling domain. "First-generation" CARs include those that solely provide CD3zeta signals upon antigen binding, "Second-generation" CARs include those that provide both costimulation (e.g. CD28 or CD 137) and activation (CD3Q). "Third-generation" CARs include those that provide multiple costimulation (e.g. CD28 and CD 137) and activation (CO3Q). In various embodiments, the CAR is selected to have high affinity or avidity for the antigen. Further discussion of CARs can be found, e.g., in Maus et al. Blood 2014 123:2624-35; Reardon et al. Neuro-Oncology 2014 16:1441-1458; Hoyos et al. Haematologica 2012 97:1622; Byrd et al. J Clin Oncol 2014 32:3039-47; Maher et al. Cancer Res 2009 69:4559-4562; and Tamada et al. Clin Cancer Res 2012 18:6436-6445; each of which is incorporated by reference herein in its entirety.

As used herein, "multi-component CAL" refers to a CAL comprising at least two separate polypeptides, neither of which polypeptides is capable of both ligand recognition and signaling activation on its own. As used herein, "multi-component CAR" refers to a CAR comprising at least two separate polypeptides, neither of which polypeptides is capable of both ligand recognition and signaling activation on its own. In some embodiments, the at least two separate polypeptides each comprise a protein interaction domain that permits interaction, e.g., binding of the separate polypeptides. In some embodiments, one of the at least two separate polypeptides is a transmembrane polypeptide having an intracellular T cell receptor (TCR) signaling domain and a second of the at least two separate polypeptides is an extracellular polypeptide having a ligand-binding domain. In some embodiments, a multi-component CAL and/or CAR can comprise two, three, four, five, six, seven, eight, nine, ten or more separate polypeptides.

Various aspects provided herein provide a composition comprising multiple components of a multi-component CAL and/or CAR.

In one aspect of the embodiments is a composition, e.g., a single molecule, comprising a TCR recognition domain; and one or both of: (a) an intracellular signaling domain; and (b) a first-type protein interaction domain. In one aspect of the embodiments is a composition, e.g., a single molecule comprising a TCR recognition domain; and a first-type biomolecular (e.g., protein) interaction domain. Further provided herein is a multi-component CAL and/or CAR comprising a TCR recognition domain; and one or both of: (a) an intracellular signaling domain; and (b) a first-type protein interaction domain. In some embodiments, the composition, e.g, single molecule, comprising a TCR recognition domain; and a first-type biomolecular (e.g., protein) interaction domain does not comprise an antibody, antibody domain, or antibody reagent.

Another aspect of the embodiments is a composition comprising (a) a first polypeptide comprising a TCR recognition domain and a first-type protein interaction domain; and (b) a signaling polypeptide comprising a second-type protein interaction domain and an intracellular signaling domain; wherein the first-type and second-type protein interaction domains bind specifically to each other. Further provided herein is a multi-component CAL and/or CAR comprising a) a first polypeptide comprising a TCR recognition domain and a first-type protein interaction domain; and (b) a signaling polypeptide comprising a second-type protein interaction domain and an intracellular signaling domain; wherein the first-type and second-type protein interaction domains bind specifically to each other.

Another aspect of the embodiments is a composition comprising (a) a first polypeptide comprising a TCR recognition domain and a first-type protein interaction domain; and (b) a recognition polypeptide comprising a second recognition domain and a third-type protein interaction domain; wherein the first-type and third-type protein interaction domains bind specifically to each other. Further provided herein is a multi-component CAL and/or CAR comprising (a) a first polypeptide comprising a TCR recognition domain and a first-type protein interaction domain; and (b) a recognition polypeptide comprising a second recognition domain and a third-type protein interaction domain; wherein the first-type and third-type protein interaction domains bind specifically to each other Another aspect of the embodiments is a composition comprising (a) a first polypeptide comprising a TCR recognition domain and a first-type protein interaction domain; and (b) a signaling polypeptide comprising a second-type protein interaction domain and an intracellular signaling domain; and (c) a recognition polypeptide comprising a second recognition domain and a third-type protein interaction domain; wherein the second-type and third-type protein interaction domains compete for binding to the first-type protein interaction domain. Further provided herein is a multi-component CAL and/or CAR comprising (a) a first polypeptide comprising a TCR recognition domain and a first-type protein interaction domain; and (b) a signaling polypeptide comprising a second-type protein interaction domain and an intracellular signaling domain; and (c) a recognition polypeptide comprising a second recognition domain and a third-type protein interaction domain; wherein the second-type and third-type protein interaction domains compete for binding to the first-type protein interaction domain.

In various embodiments, the third-type protein interaction domain and first-type protein interaction domain have a higher affinity for each other than the second-type protein interaction domain and first-type protein interaction domain. Affinity can be measured by one skilled in the art using standard methods, for example, by measuring its equilibrium dissociation constant ($K_d$).

Another aspect of the embodiments is a composition comprising (a) a first polypeptide comprising a TCR recognition domain and a first-type protein interaction domain; (b) a signaling polypeptide comprising a second-type protein interaction domain, a fourth-type protein interaction domain, and an intracellular signaling domain; and (c) a recognition polypeptide comprising a second recognition domain and a fifth-type protein interaction domain; wherein the first-type protein interaction domain and the second-type protein interaction domain bind specifically to each other; and wherein the fourth-type protein interaction domain and the fifth-type protein interaction domain bind specifically to each other. Further provided herein is a multi-component CAL and/or CAR comprising (a) a first polypeptide comprising a TCR recognition domain and a first-type protein interaction domain; (b) a signaling polypeptide comprising a second-type protein interaction domain, a fourth-type protein interaction domain, and an intracellular signaling domain; and (c) a recognition polypeptide comprising a second recognition domain and a fifth-type protein interaction domain; wherein the first-type protein interaction domain and the second-type protein interaction domain bind specifically to each other; and wherein the fourth-type protein interaction domain and the fifth-type protein interaction domain bind specifically to each other.

In various embodiments, the fourth-type protein interaction domain and fifth-type protein interaction domain have a weaker affinity than the second-type protein interaction domain and first-type protein interaction domain. Affinity can be measured as described above.

In various embodiments, the first polypeptide further comprises a sixth-type protein interaction domain and the recognition polypeptide further comprises a seventh-type protein interaction domain which bind specifically to each other.

In some embodiments, the first polypeptide comprises the entire TCR recognition domain. In some embodiments, the TCR recognition domain comprises at least two separate polypeptide sequences, the first polypeptide comprises at least one of the separate polypeptide sequences of the TCR recognition domain, and the first polypeptide is bound to or complexed with a second or further polypeptide sequences of the TCR recognition domain to form a TCR recognition domain.

In some embodiments, a composition described herein can comprise multiple copies or instances of a TCR recognition domain(s), e.g. the TCR recognition domain can be a multimer, or oligomer. In some embodiments, a composition described herein can comprise multiple copies or instances of a first polypeptide as described herein.

In various embodiments, the second recognition domain is specific for a target that is not recognized by the TCR recognition domain. In one embodiment, the second recognition domain is specific for a target that is found on a healthy and/or non-target cell and not on a diseased and/or target cell.

As used herein, "TCR recognition domain" refers to a domain or portion of a polypeptide that can target or bind specifically to a TCR, e.g., a TCR expressed on the surface of T cell. In some embodiments, the TCR recognition domain can be a TCR variable region (TCR-VR) recognition domain, i.e. is can target or bind specifically to the variable region of a TCR, e.g., a TCR expressed on the surface of a T cell. The TCR recognition domain sequence can be autologous, allogeneic, or xenogeneic to a given subject. In some embodiments, the TCR recognition domain sequence is a wild-type protein or sequence. In some embodiments, the TCR recognition domain sequence is a naturally-occurring variant, e.g., an allele of a wild-type protein or sequence. In some embodiments, the TCR recognition domain sequence is modified relative to a wild-type protein, e.g. chemically modified. In some embodiments, the TCR recognition domain sequence is a derivative and/or variant of a wild-type sequence. In some embodiments, the TCR recognition domain sequence can be a human, or non-human sequence.

A TCR recognition domain can comprise a MHC polypeptide, a MHC polypeptide sequence, and/or comprise a portion of a MHC sequence. The MHC and/or MHC sequence can be autologous, allogeneic, or xenogeneic to a given subject. In some embodiments, the MHC and/or MHC sequence is a wild-type protein or sequence. In some embodiments, the MHC and/or MHC sequence is a naturally-occurring variant, e.g., an allele of MHC. In some embodiments, the MHC and/or MHC sequence is modified relative to a wild-type protein, e.g. chemically modified. In some embodiments, the MHC and/or MHC sequence is a derivative and/or variant of a wild-type MHC sequence. In some embodiments, the MHC and/or MHC sequence can be or comprise a human, or non-human sequence.

In one embodiment, the TCR recognition domain comprises a MHC (Major Histocompatibility Complex), a MHC-peptide complex, or a MHC-peptide fusion. In some embodiments, the TCR recognition domain can comprise a featureless peptide MHC, or a MHC without peptides, or any other molecule that can target or bind specifically to the variable region of the TCR.

The MHC, which is also referred to as the human leukocyte antigen (HLA), is comprised of a set of genes that code for cell surface proteins essential for the acquired. e.g., adaptive immune system to recognize foreign molecules in vertebrates, which in turn determines histocompatibility. The MHC gene family is divided into three subgroups: MHC class I, MHC class II, and MHC class III. Class I MHC molecules have the β2 microglobulin subunit which can only be recognised by CD8 co-receptors. Class II MHC molecules have β1 and β2 subunits and can be recognized by CD4 co-receptors. In this way MHC molecules chaperone, which type of lymphocytes bind to the given antigen with high affinity, since different lymphocytes express different T-Cell Receptor (TCR) co-receptors. Components of the MHC are known in the art and can be readily identified by a skilled person. The MHC is further described in, e.g., Janeway C A Jr, Travers P, Walport M, et al, Immunobiology: The Immune System in Health and Disease, 5th edn (New York: Garland Science, 2001); Vigneron N, Stroobant V, Chapiro J, Ooms A, Degiovanni G, Morel S, et al. (April 2004). "An antigenic peptide produced by peptide splicing in the proteasome". Science. 304 (5670): 587-90; and K. Murphy, "Antigen recognition by T cells," in Janeway's Immunobiology, 8th, Ed., Garland Science, 2012, pp. 138-153; which are incorporated herein by reference in their entireties. A complete MHC class I complex comprises one MHC class I heavy chain, one peptide ligand sequence, and a beta 2 microglobulin. In some embodiments, a TCR recognition domain comprises one MHC class I heavy chain, one peptide ligand sequence, and a beta 2 microglobulin. A complete MHC class II complex comprises an MHC class II alpha chain, MHC class II beta chain, and one peptide ligand sequence. In some embodiments, a TCR recognition domain comprises an MHC class II alpha chain, MHC class II beta chain, and one peptide ligand sequence. These three components can either be assembled together as separate sequences (e.g., by intramolecular binding of multiple peptide molecules) or can be expressed as fusion proteins with intervening linker sequences (e.g., see Schmittnaegel et al., 2016; which is incorporated by reference herein in its entirety).

The MHC (Major Histocompatibility Complex), MHC-peptide complex, MHC-peptide fusion, featureless peptide MHC, can be selected on the basis of the disease or condition to be treated/prevented. Specific MHCs, peptides, and/or antigens that are associated with the diseases described herein are known in the art and an appropriate MHC, peptide, and/or antigen can be selected by one of ordinary skill in the art. For example, databases of suitable MHC, peptide, and/or antigen sequences are available on the world wide web at iedb.org; immunespace.org; immgen.org; import/org; peptideatlast.org/repository/; uniprot.org; ncbi.nlm.nih.gov/protein/; immunedata.org/index.php; immuneprofiling.org/hipc/; allergenonline.org/database-browe.shtml; and itntrialshare.org. Further examples are also provided in Smatti et al. 2019 Viruses 11:762; Beretta-Piccoli et al. 2019 J Autoimmu 94:1-6; and Cusick et al. 2012 Clinical Reviews in Allergy and Immunology; each of which is incorporated by reference herein in its entirety. The specific examples of TCR recognition domains provides herein are exemplary and non-limiting. One of skill in the art can identify relevant auto-antigenic pMHCs, allogeneic peptide MHCs, and autogenic peptide MHCs in addition to those described herein, e.g., from the art and/or from donor cells. Such identification is within the skill of the ordinary practitioner.

As an illustrative and non-limiting example, for compositions and methods relating to type 1 diabetes, the TCR recognition domain can comprise one or more of SEQ ID NOs: 8-17. In some embodiments, the TCR recognition domain can comprise SEQ ID NO: 8, 9, and one of 10-17. In some embodiments, the TCR recognition domain can comprise sequences with at least 80%, at least 85%, at least 90%, at least 95%, at least 98% or greater sequence identity to SEQ ID NO: 8, 9, and one of 10-17. In some embodiments, the TCR recognition domain can comprise sequences with at least 95% sequence identity to SEQ ID NO: 8, 9, and one of 10-17, and which retain the wild-type activity of SEQ ID NOs: 8, 9, and one of 10-17.

HLA-A*0201 (MHC class Iheavy chain allele, wildtype, human)
SEQ ID NO: 8
MAVMAPRTLVLLLSGALALTQTWAGSHSMRYFFTSVSRPGRGEPRFIAVG

YVDDTQFVRFDSDAASQRMEPRAPWIEQEGPEYWDGETRKVKAHSQTHRV

DLGTLRGYYNQSEAGSHTVQRMYGCDVGSDWRFLRGYHQYAYDGKDYIAL

KEDLRSWTAADMAAQTTKHKWEAAHVAEQLRAYLEGTCVEWLRRYLENGK

ETLQRTDAPKTHMTHHAVSDHEATLRCWALSFYPAEITLTWQRDGEDQTQ

DTELVETRPAGDGTFQKWAAVVVPSGQEQRYTCHVQHEGLPKPLTLRWEP

SSQPTIPIVGIIAGLVLFGAVITGAVVAAVMWRRKSSDRKGGSYSQAASS

DSAQGSDVSLTACKV

Beta-2 microglobulin (wildtype, human)
SEQ ID NO: 9
MSRSVALAVLALLSLSGLEGIQRTPKIQVYSRHPAENGKSNFLNCYVSGF

HQSDIEVDLLKNGERIEKVEHSDLSFSKDWSFYLLYYTEFTPTEKDEYAC

RVNHVTLSQPKIVKWDRDM

Preproinsulin$_{15-24}$ (wildtype, human)
SEQ ID NO: 10
ALWGPDPAAA

Preproinsulin$_{15-24}$ altered peptide ligand #1 (synthetic, Cole et al., 2016)
SEQ ID NO: 11
AQWGPDPAAA Preproinsulin$_{15-24}$ altered peptide ligand #2 (synthetic, Cole et al., 2016)
SEQ ID NO: 12
RQWGPDPAAV Preproinsulin$_{15-24}$ altered peptide ligand #3 (wildtype, *Clostridium asparagiforme*, Cole et al., 2016)
SEQ ID NO: 13
RQFGPDWIVA Preproinsulin$_{15-24}$ altered peptide ligand #4 (synthetic, Cole et al., 2016)
SEQ ID NO: 14
YQFGPDFPIA Preproinsulin$_{15-24}$ altered peptide ligand #5 (synthetic, Cole et al., 2016)
SEQ ID NO: 15
RQFGPDFPTI Preproinsulin$_{15-24}$ altered peptide ligand #6 (synthetic, Cole et al., 2016)
SEQ ID NO: 16
YLGGPDFPTI Preproinsulin$_{15-24}$ altered peptide ligand #7 (wildtype, *Bacteroides fragilis*, Cole et al., 2016)
SEQ ID NO: 17
MVWGPDLYV As a further illustrative example, for compositions and methods relating vitiligo, the TCR recognition domain can comprise one or more of SEQ ID NOs: 18-22. In some embodiments, the TCR recognition domain can comprise SEQ ID NO: 18, 19, and one of 20-22. In some embodiments, the TCR recognition domain can comprise sequences with at least 80%, at least 85%, at least 90%, at least 95%, at least 98% or greater sequence identity to SEQ ID NO: 18, 19, and one of 20-22. In some embodiments, the TCR recognition domain can comprise sequences with at least 95% sequence identity to SEQ ID NO: 18, 19, and one of 20-22, and which retain the wild-type activity of SEQ ID NOs: 18, 19, and one of 20-22.

HLA-A*0201 (MHC class I heavy chain allele,
wildtype, human, same as previous HLA-A2)
SEQ ID NO: 18
MAVMAPRTLVLLLSGALALTQTWAGSHSMRYFFTSVSRPGRGEPRFIAVG

YVDDTQFVRFDSDAASQRMEPRAPWIEQEGPEYWDGETRKVKAHSQTHRV

DLGTLRGYYNQSEAGSHTVQRMYGCDVGSDWRFLRGYHQYAYDGKDYIAL

KEDLRSWTAADMAAQTTKHKWEAAHVAEQLRAYLEGTCVEWLRRYLENGK

ETLQRTDAPKTHMTHHAVSDHEATLRCWALSFYPAEITLTWQRDGEDQTQ

DTELVETRPAGDGTFQKWAAVVVPSGQEQRYTCHVQHEGLPKPLTLRWEP

SSQPTIPIVGIIAGLVLFGAVITGAVVAAVMWRRKSSDRKGGSYSQAASS

DSAQGSDVSLTACKV

Beta-2 microglobulin (wildtype, human, same as
previous Beta-2 microglobulin)
SEQ ID NO: 19
MSRSVALAVLALLSLSGLEGIQRTPKIQVYSRHPAENGKSNFLNCYVSGF

HQSDIEVDLLKNGERIEKVEHSDLSFSKDWSFYLLYYTEFTPTEKDEYAC

RVNHVTLSQPKIVKWDRDM

MART-1$_{26-35}$ (wildtype, human)
SEQ ID NO: 20
ELAGIGILTV

Tyrosinase$_{368-376}$ (wildtype, human)
SEQ ID NO: 21
YMDGTMSQV gp100$_{209-217}$ (wildtype, human)
SEQ ID NO: 22
ITDQVPFSV As further illustrative and non-limiting examples, the following pairs of MHC and antigens provided in Table 5 are known in the art. In some embodiments, the TCR recognition domain can comprise one or more of the following indicated MHC/peptide pairs, e.g., the TCR recognition domain can comprise one of the indicated MHC alleles and the indicated corresponding peptide. In some embodiments, the TCR recognition domain can comprise sequences with at least 80%, at least 85%, at least 90%, at least 95%, at least 98% or greater sequence identity to one of the following indicated MHC/peptide pairs, e.g., one of the indicated MHC alleles and the indicated corresponding peptide. In some embodiments, the TCR recognition domain can comprise sequences with at least 95% sequence identity to one of the following indicated MHC/peptide pairs, e.g., one of the indicated MHC alleles and the indicated corresponding peptide, wherein those sequences retain the wild-type activity of the MHC allele and the corresponding peptide.

TABLE 5

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| MHC allele | Peptide (SEQ ID NO) | Antigen/Disease |
|---|---|---|
| HLA-A*0201 | VMNILLQYVV (SEQ ID NO: 2013) | GAD65 Diabetes |
| HLA-A*0201 | VMNILLQYVV (SEQ ID NO: 2013) | GAD65 Diabetes |
| HLA-A*0201 | YAYDGKDYIA (SEQ ID NO: 2014) | HLA-A2 Diabetes |
| HLA-A*0201 | MVWESGCTV (SEQ ID NO: 2015) | IA-2 Diabetes |
| HLA-A*0201 | VIVMLTPLV (SEQ ID NO: 2016) | IA-2 Diabetes |
| HLA-A*0201 | YTCPLCRAPV (SEQ ID NO: 2017) | SAA Autoimmune |
| HLA-A*0201 | YMDGTMSQV (SEQ ID NO: 2018) | Tyrosinase Vitiligo |
| HLA-A*0301 | YMVPFIPLYR (SEQ ID NO: 2019) | Tyrosinase Vitiligo |
| HLA-A*2402 | AFLPWHRLF (SEQ ID NO: 2020) | Tyrosinase Vitiligo |
| HLA-A*0101 | SSDYVIPIGTY (SEQ ID NO: 2021) | Tyrosinase Vitiligo |
| HLA-A*02:01 | VLHDDLLEA (SEQ ID NO: 2022) | HA-1 137-145 Minor Histocompatibility Antigen |
| HLA-A*02:01 | RTLDKVLEV (SEQ ID NO: 2023) | miHAg HA-8 Minor Histocompatibility Antigen |
| HLA-A*02:01 | FIDSYICQV (SEQ ID NO: 2024) | miHAg H-Y (human SMCY) 311-319 Minor Histocompatibility Antigen |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| MHC allele | Peptide | Antigen |
|---|---|---|
| DRB1*04:01 | GAGSLQPLALEGSLQKRG A (SEQ ID NO: 2025) | Proinsulin 73-90 |
| DRB1*04:01 | IAFTSEHSHFSLK A (SEQ ID NO: 2026) | GAD65 274-286 |
| DRB1*04:01 | DENPVVHFFKNIVTPRTPP (SEQ ID NO: 2027) | Myelin basic protein 83-101 |
| DRB1*04:01 | GIVEQCCTSICSLYQ A (SEQ ID NO: 2028) | Proinsulin 90-104 |
| DRB1*04:01 | NFIRMVISNPAAT A (SEQ ID NO: 2029) | GAD65 555-567 |
| DRB1*04:01 | DVMNILLQYVVKSFDRSTKV (SEQ ID NO: 2030) | GAD65 13-132 |
| HLA-A*0201 | ALWGPDPAAA (SEQ ID NO: 2031) | Insulin Diabetes |
| HLA-A*0201 | HLVEALYLV (SEQ ID NO: 2032) | Insulin Diabetes |
| HLA-A*0201 | KLQVFLIVL (SEQ ID NO: 2033) | IAPP Diabetes |
| HLA-A*0101 | IVDCLTEMY (SEQ ID NO: 2034) | USP9Y Graft vs Host |
| HLA-A*0201 | VLHDDLLEA (SEQ ID NO: 2035) | HA-1 Graft vs Host |
| HLA-A*0201 | RTLDKVLEV (SEQ ID NO: 2036) | HA-8 Graft vs Host |
| HLA-A*0201 | FIDSYICQV (SEQ ID NO: 2037) | H-Y Graft vs Host |
| HLA-B*0702 | SPSVDKARAEL (SEQ ID NO: 2038) | SMCY Graft vs Host |
| HLA-B*0801 | LPHNHTDL (SEQ ID NO: 2039) | TPR-protein Graft vs Host |
| Antigen Mimicry | | |
| HLA-A*0201 | FLDKGTYTL (SEQ ID NO: 2040) | BALF4 EBV |
| HLA-A*0201 | GLCTLVAML (SEQ ID NO: 2041) | BMLF1 EBV |
| HLA-A*0201 | TLDYKPLSV (SEQ ID NO: 2042) | BMRF1 EBV |
| HLA-A*0201 | YVLDHLIVV (SEQ ID NO: 2043) | BRLF1 EBV |
| HLA-A*0201 | LLDFVRFMGV (SEQ ID NO: 2044) | EBNA 3B EBV |
| HLA-A*0201 | YLLEMLWRL (SEQ ID NO: 2045) | LMP-1 EBV |
| HLA-A*0201 | YLQQNWWTL (SEQ ID NO: 2046) | LMP-1 EBV |
| HLA-A*0201 | CLGGLLTMV (SEQ ID NO: 2047) | LMP-2A EBV |
| HLA-A*0201 | FLYALALLL (SEQ ID NO: 2048) | LMP-2A EBV |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| HLA-A*0301 | RLRAEAQVK (SEQ ID NO: 2049) | EMNA 3A EBV |
| HLA-A*1101 | AVFDRKSDAK (SEQ ID NO: 2050) | EBNA 3B EBV |
| HLA-A*1101 | IVTDFSVIK (SEQ ID NO: 2051) | EBNA 3B EBV |
| HLA-A*2402 | DYCNVLNKEF (SEQ ID NO: 2052) | BRLF1 EBV |
| HLA-A*2402 | TYGPVFMCL (SEQ ID NO: 2053) | LMP-2 EBV |
| HLA-A*2902 | IACPIVMRY (SEQ ID NO: 2054) | BRLF1 EBV |
| HLA-A*6801 | IVTDFSVIK (SEQ ID NO: 2051) | EBNA 3B EBV |
| HLA-B*0702 | RPQGGSRPEFVKL (SEQ ID NO: 2055) | BMRF1 EBV |
| HLA-B*0702 | RPPIFIRRL (SEQ ID NO: 2056) | EBNA 3A EBV |
| HLA-B*0702 | QPRAPIRPI (SEQ ID NO: 2057) | EBNA 6 EBV |
| HLA-B*0801 | RAKFKQLL (SEQ ID NO: 2058) | BZLF1 EBV |
| HLA-B*0801 | FLRGRAYGL (SEQ ID NO: 2059) | EBNA 3A EBV |
| HLA-B*3501 | EPLPQGQLTAY (SEQ ID NO: 2060) | BZLF1 EBV |
| HLA-B*3501 | EPLSQSQITAY (SEQ ID NO: 2061) | BZLF1 EBV |
| HLA-B*3501 | HPVAEADYFEY (SEQ ID NO: 2062) | BZLF1 1 EBV |
| HLA-B*3501 | HPVGDADYFEY (SEQ ID NO: 2063) | EBNA 1 EBV |
| HLA-B*3501 | HPVGEADYFEY (SEQ ID NO: 2064) | EBNA 1 EBV |
| HLA-B*3501 | HPVGQADYFEY (SEQ ID NO: 2065) | EBNA 1 EBV |
| HLA-B*3501 | YPLHEQHGM (SEQ ID NO: 2066) | EBNA 3A EBV |
| HLA-A*0101 | YTEHDTLLY (SEQ ID NO: 2067) | UL44 CMV |
| HLA-A*0201 | VLEETSVML (SEQ ID NO: 2068) | IE-1 CMV |
| HLA-A*0201 | NLVPMVATV (SEQ ID NO: 2069) | pp65 CMV |
| HLA-A*0301 | KLGGALQAK (SEQ ID NO: 2070) | IE-1 CMV |
| HLA-A*2301 | QYDPVAALF (SEQ ID NO: 2071) | pp65 CMV |
| HLA-A*2402 | AYAQKIFKI (SEQ ID NO: 2072) | IE-1 CMV |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| MHC allele | Peptide | Antigen source |
|---|---|---|
| HLA-A*2402 | QYDPVAALF (SEQ ID NO: 2071) | pp65 CMV |
| HLA-A*2402 | VYALPLKML (SEQ ID NO: 2073) | pp65 CMV |
| HLA-B*0702 | RPHERNGFTVL (SEQ ID NO: 2074) | pp65 CMV |
| HLA-B*0702 | TPRVTGGGAM (SEQ ID NO: 2075) | pp65 CMV |
| HLA-B*0801 | ELRKMIYM (SEQ ID NO: 2076) | IE-1 CMV |
| HLA-B*0801 | ELNRKMIYM (SEQ ID NO: 2077) | IE-1 CMV |
| HLA-B*0801 | ELRRKMMYM (SEQ ID NO: 2078) | IE-1 CMV |
| HLA-B*0801 | QIKVRVDMV (SEQ ID NO: 2079) | IE-1 CMV |
| HLA-B*3501 | IPSINVHHY (SEQ ID NO: 2080) | pp65 CMV |
| HLA-B*3501 | LPLNVGLPIIGVM (SEQ ID NO: 2081) | UL138 CMV |
| A*01: 01 | SADNNNSEY (SEQ ID NO: 2082) | AAV VP1 492-500 |
| A*01: 01 | TDLGQNLLY (SEQ ID NO: 2083) | Adenovirus 5 Hexon 886-894 |
| A*01: 01 | EADPTGHSY (SEQ ID NO: 2084) | MAGE-A1 161-169 |
| A*01: 01 | EVDPIGHLY (SEQ ID NO: 2085) | MAGE-A3 168-176 |
| A*01: 01 | KSDICTDEY (SEQ ID NO: 2086) | Tyrosinase 243-251 (244S) |
| A*01: 01 | KCDICTDEY (SEQ ID NO: 2087) | Tyrosinase 243-251 |
| A*01: 01 | QSLEIISRY (SEQ ID NO: 2088) | Mcl-1 177-185 |
| A*01: 01 | YVDFREYEYY (SEQ ID NO: 2089) | FLT3 ITD |
| A*01: 01 | TLDTLTAFY (SEQ ID NO: 2090) | Mesothelin 429-437 |
| A*01: 01 | LTDDRLFTCY (SEQ ID NO: 2091) | PLEKHM2 |
| A*01: 01 | DSDPDSFQDY (SEQ ID NO: 2092) | Tyr Ala 454-463 |
| A*01: 01 | EADPIGHLY (SEQ ID NO: 2093) | MAGEA3 |
| A*01: 01 | EVDPASNTY (SEQ ID NO: 2094) | MAGE-A4 169-177 |
| A*01: 01 | HSTNGVTRIY (SEQ ID NO: 2095) | PSMA |
| A*01: 01 | ILDTAGREEY (SEQ ID NO: 2096) | N-ras 55-64 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Sequence | Antigen |
|---|---|---|
| A*01:01 | LVDVMPWLQY (SEQ ID NO: 2097) | Cytochrome P450 240-249 |
| A*01:01 | RSDSGQQARY (SEQ ID NO: 2098) | AIM-2 |
| A*01:01 | VTEPGTAQY (SEQ ID NO: 2099) | Minor antigen HA-3T (Lbc oncogene 451-459) |
| A*01:01 | VYDFFVWLHY (SEQ ID NO: 2100) | TRP-2 181-190 |
| A*01:01 | YSEHPTFTSQY (SEQ ID NO: 2101) | HCMV pp65 363-373 |
| A*01:01 | VTEHDTLLY (SEQ ID NO: 2102) | HCMV pp50 245-253 |
| A*01:01 | FTSDYYQLY (SEQ ID NO: 2103) | SARS-CoV-2 ORF3a 207-215 (confirmed epitope) |
| A*01:01 | TTDPSFLGRY (SEQ ID NO: 2104) | SARS-CoV-2 Replicase polyprotein 1ab 1637-1646 |
| A*01:01 | PTDNYITTY (SEQ ID NO: 2105) | SARS-CoV-2 Replicase polyprotein 1ab 1621-1629 |
| A*01:01 | LLDTASALY (SEQ ID NO: 2106) | HBV core 30-38 |
| A*01:01 | ATDALMTGY (SEQ ID NO: 2107) | HCV NS3 1435-1443 |
| A*01:01 | ATDALMTGF (SEQ ID NO: 2108) | HCV NS3 1436-1444 |
| A*01:01 | CTELKLSDY (SEQ ID NO: 2109) | Influenza A (PR8) NP 44-52 |
| A*01:01 | VSDGGPNLY (SEQ ID NO: 2110) | Influenza A PB1 591-599 |
| A*01:01 | IVDCLTEMY (SEQ ID NO: 2111) | DRRFY (1521-1529)) |
| A*0201 | ALCNTDSPL (SEQ ID NO: 2112) | iLR1 |
| A*0201 | ALKDVEERV (SEQ ID NO: 2113) | MAGE-C2 336-344 |
| A*0201 | LLAARAIVAI (SEQ ID NO: 2114) | iLR1 59-68 |
| A*0201 | RLWQELSDI (SEQ ID NO: 2115) | circadian clock protein PASD1 691-700 |
| A*0201 | LLFGLALIEV (SEQ ID NO: 2116) | MAGE-C2 191-200 |
| A*0201 | FLDPRPLTV (SEQ ID NO: 2117) | CYP190 |
| A*0201 | STLCQVEPV (SEQ ID NO: 2118) | MPP11 |
| A*0201 | VLQMKEEDV (SEQ ID NO: 2119) | iLR1 |
| A*0201 | AIQDLCLAV (SEQ ID NO: 2120) | NPM1 |
| A*0201 | QLLIKAVNL (SEQ ID NO: 2121) | MPP11 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Sequence | Antigen |
|---|---|---|
| A*0201 | AIQDLCVAV (SEQ ID NO: 2122) | NPM1 |
| A*0201 | ALTPVVVTL (SEQ ID NO: 2123) | cyclin-dependent kinase 4 170-178 |
| A*02:01 | KLQVFLIVL (SEQ ID NO: 2124) | T1D Diabetes human prepro islet amyloid polypeptide pplAPP 513 |
| A*02:01 | VMNILLQYV (SEQ ID NO: 2125) | GAD65 114-123 |
| A*02:01 | SLSRFSWGA (SEQ ID NO: 2126) | Myelin basic protein 110-118 |
| A*02:01 | HLVEALYLV (SEQ ID NO: 2127) | Insulin B chain 10-18 |
| A*02:01 | LNIDLLWSV (SEQ ID NO: 2128) | T1D Diabetes IGRP 228-236 |
| A*02:01 | VLFGLGFAI (SEQ ID NO: 2129) | T1D Diabetes IGRP 265-273 |
| A*02:01 | ALWGPDPAAA (SEQ ID NO: 2130) | Proinsulin precursor 15-24 |
| A*02:01 | MVWESGCTV (SEQ ID NO: 2131) | IA-2 797-805 |
| A*02:01 | YTCPLCRAPV (SEQ ID NO: 2132) | SSA SS-56 55-64 |
| A*02:01 | VIVMLTPLV (SEQ ID NO: 2133) | IA-2 805-813 |
| A*02:01 | AITEVECFL (SEQ ID NO: 2134) | VP1 44-52 |
| A*02:01 | FLHCIVFNV (SEQ ID NO: 2135) | large Tantigen 410-418 |
| A*02:01 | LLMWEAVTV (SEQ ID NO: 2136) | VP1 108-116 |
| A*02:01 | CLLPKMDSV (SEQ ID NO: 2137) | large Tantigen 398-406 |
| A*02:01 | FLWGPRALV (SEQ ID NO: 2138) | MAGEA3 271-279 |
| A*02:01 | IMDQVPFSV (SEQ ID NO: 2139) | gp100 (pmel17) 209-217 |
| A*02:01 | YLEPGPVTV (SEQ ID NO: 2140) | gp100 (pmel) 280-288 (288V) |
| A*02:01 | YLSGADLNL (SEQ ID NO: 2141) | Carcinoembryonic antigen (CEA)-derived peptide CAP1-6D |
| A*02:01 | SLLMWITQC (SEQ ID NO: 2142) | NY-ESO-1 157-165 (9C) |
| A*02:01 | KTWGQYWQV (SEQ ID NO: 2143) | gp100 (pmel17) 154-162 |
| A*02:01 | YLEPGPVTA (SEQ ID NO: 2144) | gp100 |
| A*02:01 | YMDGTMSQV (SEQ ID NO: 2145) | Tyrosinase 369-377 (371D) |
| A*02:01 | YLSGANLNL (SEQ ID NO: 2146) | Carcinogenic Embryonic Antigen (CEA) 571-579 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | | |
|---|---|---|---|
| A*02: 01 | ELAGIGILTV (SEQ ID NO: 2147) | | MelanA/MART26-35 |
| A*02: 01 | ILAKFLHWL (SEQ ID NO: 2148) | | Telomerase 540-548 |
| A*02: 01 | ALQPGTALL (SEQ ID NO: 2149) | | Prostate Stem Cell Antigen (PSCA) 14-22 |
| A*02: 01 | VISNDVCAQV (SEQ ID NO: 2150) | | Prostate Specific Antigen-1 (PSA-1) 154-163 |
| A*02: 01 | RLVDDFLLV (SEQ ID NO: 2151) | | Telomerase Reverse Transcriptase 865-873 |
| A*02: 01 | GVLVGVALI (SEQ ID NO: 2152) | | Carcinogenic Embryonic Antigen (CEA) 694-702 |
| A*02: 01 | VLYRYGSFSV (SEQ ID NO: 2153) | | gp100 (pmel17) 476-485 |
| A*02: 01 | PLFQVPEPV (SEQ ID NO: 2154) | | Alpha-fetoprotein isoform 1 137-145 |
| A*02: 01 | FMNKFIYEI (SEQ ID NO: 2155) | | Human alfa fetoprotein 158-166 |
| A*02: 01 | GLSPNLNRFL (SEQ ID NO: 2156) | | Alpha-fetoprotein isoform 2 167-176 |
| A*02: 01 | KVLEYVIKV (SEQ ID NO: 2157) | | MAGEA1 278-286 |
| A*02: 01 | LLGRNSFEV (SEQ ID NO: 2158) | | p53 264-272 |
| A*02: 01 | LLLLTVLTV (SEQ ID NO: 2159) | | MUC-1 12-20 |
| A*02: 01 | ILHNGAYSL (SEQ ID NO: 2160) | | HER-2/neu 435-443 |
| A*02: 01 | RLLQETELV (SEQ ID NO: 2161) | | HER-2/neu 689-697 |
| A*02: 01 | KIFGSLAFL (SEQ ID NO: 2162) | | HER-2/neu 369-377 |
| A*02: 01 | LLLLDVAPL (SEQ ID NO: 2163) | | HSP1A 459-467 |
| A*02: 01 | LLDVAPLSL (SEQ ID NO: 2164) | | HSP1A 461-469 |
| A*02: 01 | HLYQGCQVV (SEQ ID NO: 2165) | | Receptor tyrosine-protein kinase erbB-2 48-56 |
| A*02: 01 | HLSTAFARV (SEQ ID NO: 2166) | | G250 (renal cell carcinoma) 217-225 |
| A*02: 01 | VLQELNVTV (SEQ ID NO: 2167) | | Leukocyte Proteinase-3 (Wegener's autoantigen) 169-177 |
| A*02: 01 | KVAELVHFL (SEQ ID NO: 2168) | | MAGEA3 112-120 |
| A*02: 01 | VLAGVGFFI (SEQ ID NO: 2169) | | EPHA2 550-558 |
| A*02: 01 | FLYTLLREV (SEQ ID NO: 2170) | | STEAP 86-94 |
| A*02: 01 | ILLWQPIPV (SEQ ID NO: 2171) | | Prostatic Acid Phosphatase-3 (PAP-3) 135-143 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| MHC allele | Peptide | Antigen source |
|---|---|---|
| A*02:01 | RLQEERTCKV (SEQ ID NO: 2172) | BIR |
| A*02:01 | QLCPICRAPV (SEQ ID NO: 2173) | Livin/ML-IAP280 175-184 |
| A*02:01 | VLGEAWRDQV (SEQ ID NO: 2174) | TRAP 45-54 |
| A*02:01 | LLLTVLTVV (SEQ ID NO: 2175) | Tumor Mucin Antigen 13-21 |
| A*02:01 | GLYDGMEHL (SEQ ID NO: 2176) | MAGEA-10 254-262 |
| A*02:01 | SLLMWITQV (SEQ ID NO: 2177) | NY-ESO-1 157-165 |
| A*02:01 | LMLGEFLKL (SEQ ID NO: 2178) | Survivin 96-104 |
| A*02:01 | YLFFYRKSV (SEQ ID NO: 2179) | mTERT 572-580 |
| A*02:01 | ELTLGEFLKL (SEQ ID NO: 2180) | survivin 95-104 |
| A*02:01 | FLTPKKLQCV (SEQ ID NO: 2181) | Prostate Specific Antigen-1 (PSA-1) 141-150 |
| A*02:01 | KLQCVDLHV (SEQ ID NO: 2182) | Prostate Specific Antigen 146-154 |
| A*02:01 | TLAPATEPA (SEQ ID NO: 2183) | Mucin 79-87 |
| A*02:01 | YLQVNSLQTV (SEQ ID NO: 2184) | Telomerase Reverse Transcriptase (hTRT) 988-997 |
| A*02:01 | SLGEQQYSV (SEQ ID NO: 2185) | WT1 187-195 |
| A*02:01 | SLEENIVIL (SEQ ID NO: 2186) | RHAMM 275-283 |
| A*02:01 | YMNGTMSQV (SEQ ID NO: 2187) | Tyrosinase 368-376 |
| A*02:01 | ILSLELMKL (SEQ ID NO: 2188) | Receptor for hyaluronic acid-mediatedmotility (RHAMM) 165-173 |
| A*02:01 | PLFDFSWLSL (SEQ ID NO: 2189) | Bcl-2 208-217 |
| A*02:01 | LLGATCMFV (SEQ ID NO: 2190) | CyclinD 101-109 |
| A*02:01 | ALYVDSLFFL (SEQ ID NO: 2191) | PRAME PRA 300-309 |
| A*02:01 | GLMEEMSAL (SEQ ID NO: 2192) | Human Mena protein (overexpressed in breast cancer) |
| A*02:01 | TMNGSKSPV (SEQ ID NO: 2193) | hMena 502-510 |
| A*02:01 | GVYDGREHTV (SEQ ID NO: 2194) | MAGE-A4 230-239 |
| A*02:01 | YLNDHLEPWI (SEQ ID NO: 2195) | Bcl-X 173-182 |
| A*02:01 | ALDVYNGLL (SEQ ID NO: 2196) | Prostatic acid phosphatase precursor (PAP) 299-307 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| A*02: 01 | ALFDIESKV (SEQ ID NO: 2197) | PSM P2 (prostate) |
| A*02: 01 | SLAMLDLLHV (SEQ ID NO: 2198) | Mutant anaplastic lymphoma kinase 1220-1229 |
| A*02: 01 | YLNTVQPTCV (SEQ ID NO: 2199) | EGF-R 1138-1147 |
| A*02: 01 | KLFGTSGQKT (SEQ ID NO: 2200) | EGF-R-479 350-359 |
| A*02: 01 | RMPEAAPPV (SEQ ID NO: 2201) | p53 65-73 |
| A*02: 01 | PLTSIISAV (SEQ ID NO: 2202) | Receptor tyrosine-protein kinase erb6-2 728-736 |
| A*02: 01 | VLAGGFFLL (SEQ ID NO: 2203) | PSMA 27-38 |
| A*02: 01 | LLHETDSAV (SEQ ID NO: 2204) | PSMA/PSM-P1 4-12 |
| A*02: 01 | VMAGVGSPYV (SEQ ID NO: 2205) | Receptor tyrosine-protein kinase erb6-2 819-828 |
| A*02: 01 | VLPLTVAEV (SEQ ID NO: 2206) | Mesothelin 530-538 |
| A*02: 01 | SLLFLLFSL (SEQ ID NO: 2207) | Mesothelin 20-28 |
| A*02: 01 | QLFEELQEL (SEQ ID NO: 2208) | Heme oxygenase-1 212-220 |
| A*02: 01 | VLDGLDVLL (SEQ ID NO: 2209) | PRAME 100-108 |
| A*02: 01 | RLASFYDWPL (SEQ ID NO: 2210) | BIR7 90-99 |
| A*02: 01 | LIAHNQVRQV (SEQ ID NO: 2211) | HER-2/neu (85-94) |
| A*02: 01 | ILHDGAYSL (SEQ ID NO: 2212) | HER-2 434-443 |
| A*02: 01 | FVGEFFTDV (SEQ ID NO: 2213) | GPC3 144-152 (overexpressed in hepatocellular carcinoma) |
| A*02: 01 | LLLIWFRPV (SEQ ID NO: 2214) | BKV Ltag 579-587 |
| A*02: 01 | KLQDASAEV (SEQ ID NO: 2215) | HM1.24-aa 126-134 |
| A*02: 01 | SLYSFPEPEA (SEQ ID NO: 2216) | PRAME |
| A*02: 01 | SLLQHLIGL (SEQ ID NO: 2217) | PRAME 425-433 |
| A*02: 01 | VIFDFLHCI (SEQ ID NO: 2218) | BKV Ltag 406-414 |
| A*02: 01 | VLDFAPPGA (SEQ ID NO: 2219) | WT1 |
| A*02: 01 | TLPGYPPHV (SEQ ID NO: 2220) | PAX-5 311-319 |
| A*02: 01 | YMEHNNVYTV (SEQ ID NO: 2221) | Fibromodulin 250-259 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Peptide | Antigen |
|---|---|---|
| A*02: 01 | YLQHNEIQEV (SEQ ID NO: 2222) | Fibromodulin 206-215 |
| A*02: 01 | SLVDVMPWL (SEQ ID NO: 2223) | Cytochrome p450 161 239-248 |
| A*02: 01 | RLMNDMTAV (SEQ ID NO: 2224) | HSP105 128-136 |
| A*02: 01 | RLARLALVL (SEQ ID NO: 2225) | Trophoblast glycoprotein 17-25 |
| A*02: 01 | FLTGNQLAV (SEQ ID NO: 2226) | 5T4 97-105 |
| A*02: 01 | LLLAGLFSL (SEQ ID NO: 2227) | Fibromodulin 7-15 |
| A*02: 01 | FLGYLILGV (SEQ ID NO: 2228) | Prostatic Acid Phosphatase-3 (PAP-3) |
| A*02: 01 | SLFLGILSV (SEQ ID NO: 2229) | CD20 188-196 (B cell malignancies) |
| A*02: 01 | AVLPLLELV (SEQ ID NO: 2230) | MCL-1 139-147 |
| A*02: 01 | SLSEKTVLL (SEQ ID NO: 2231) | CD59 glycoprotein precursor 106-114 |
| A*02: 01 | YMCSFLFNL (SEQ ID NO: 2232) | Ewing Tumor EZH2 666-674 |
| A*02: 01 | YLISGDSPV (SEQ ID NO: 2233) | CD33 65-73 (1Y2L) |
| A*02: 01 | KASEKIFYV (SEQ ID NO: 2234) | SSX2 41-49 |
| A*02: 01 | FLAKLNNTV (SEQ ID NO: 2235) | HCA587 317-325 |
| A*02: 01 | GLAPPQHLIRV (SEQ ID NO: 2236) | p53 187-197 |
| A*02: 01 | VIM PCSWWV (SEQ ID NO: 2237) | Chondromodulin-I 319-327 |
| A*02: 01 | KVVEFLAML (SEQ ID NO: 2238) | MAGE-C1 1083-1091 |
| A*02: 01 | LTLGEFLKL (SEQ ID NO: 2239) | Survivin-3A 96-104 |
| A*02: 01 | ALPFGFILV (SEQ ID NO: 2240) | IL13R 345-353 |
| A*02: 01 | TLADFDPRV (SEQ ID NO: 2241) | EphA2 |
| A*02: 01 | ALMEQQHYV (SEQ ID NO: 2242) | ITGB8 662-670 |
| A*02: 01 | CLTSTVQLV (SEQ ID NO: 2243) | HER-2/neu 789-797 |
| A*02: 01 | GLLGASVGL (SEQ ID NO: 2244) | Telomerase Reverse Transcriptase (hTRT) 674-683 |
| A*02: 01 | QLLDGFMITL (SEQ ID NO: 2245) | PASD1 39-48 |
| A*02: 01 | YLVGNVCIL (SEQ ID NO: 2246) | PASD1 168-176 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| A*02: 01 | ALLTSRLRFI (SEQ ID NO: 2247) | Telomerase Reverse Transcriptase (hTRT) 615-624 |
| A*02: 01 | RLSSCVPVA (SEQ ID NO: 2248) | TGF beta receptor type-2 131-139 |
| A*02: 01 | FLYDDNQRV (SEQ ID NO: 2249) | Topoisomerase II-alpha-b 828-836 |
| A*02: 01 | YLIELIDRV (SEQ ID NO: 2250) | TACE 250-258 |
| A*02: 01 | FLAEDALNTV (SEQ ID NO: 2251) | Epithelial Discoidin Domain Receptor 1 (EDDR1) 867-876 |
| A*02: 01 | GLMKYIGEV (SEQ ID NO: 2252) | TRPM8 187-195 |
| A*02: 01 | AILALLPAL (SEQ ID NO: 2253) | Prostate Stem Cell Antigen (PSCA) 105-133 |
| A*02: 01 | GLQHWVPEL (SEQ ID NO: 2254) | BA46 (Lactadherin) 97-106 |
| A*02: 01 | GVRGRVEEI (SEQ ID NO: 2255) | BCR-ABL |
| A*02: 01 | ITDQVPFSV (SEQ ID NO: 2256) | gp100 (pmel) 209-217 |
| A*02: 01 | KLCPVQLWV (SEQ ID NO: 2257) | p53 139-147 |
| A*02: 01 | KVAEELVHFL (SEQ ID NO: 2258) | MAGEA3 112-120 (alternative version) |
| A*02: 01 | SLPPPGTRV (SEQ ID NO: 2259) | p53 149-157 |
| A*02: 01 | YLGSYGFRL (SEQ ID NO: 2260) | p53 103-111 |
| A*02: 01 | YLQLVFGIEV (SEQ ID NO: 2261) | MAGEA2 157-166 |
| A*02: 01 | TLQDIVYKL (SEQ ID NO: 2262) | BMI1 74-82 |
| A*02: 01 | YAIDLPVSV (SEQ ID NO: 2263) | L-dopachrome tautomerase 488-496 |
| A*02: 01 | AMVGAVLTA (SEQ ID NO: 2264) | Tyrosinase 482-190 |
| A*02: 01 | ATVGIMIGV (SEQ ID NO: 2265) | CEACAM5 687-695 |
| A*02: 01 | YVDPVITSI (SEQ ID NO: 2266) | Hepatocyte growth factor receptor 673-681 |
| A*02: 01 | GVLLWEIFSL (SEQ ID NO: 2267) | VEGFR1 28-37 |
| A*02: 01 | LMAQEALAFL (SEQ ID NO: 2268) | CAMEL 2-11 |
| A*02: 01 | RVA(PHOSPHO-S)PTSGV (SEQ ID NO: 2269) | Insulin receptor substrate-2 1097-1105 |
| A*02: 01 | RVASPTSGV (SEQ ID NO: 2270) | IRS-2 1097-1105 |
| A*02: 01 | ALNVYNGLL (SEQ ID NO: 2271) | ACPP 299-307 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| A*02:01 | ALSPVPPVV (SEQ ID NO: 2272) | Bcl-2 85-93 |
| A*02:01 | ALVCYGPGI (SEQ ID NO: 2273) | FAP alpha 463-471 |
| A*02:01 | ALWPWLLMAT (SEQ ID NO: 2274) | RNF43 11-20 |
| A*02:01 | ALYLMELTM (SEQ ID NO: 2275) | CB9L2 |
| A*02:01 | CLPSPSTPV (SEQ ID NO: 2276) | BMI1 271-279 |
| A*02:01 | ELSDSLGPV (SEQ ID NO: 2277) | PASD1 695-703 |
| A*02:01 | FLFLRNFSL (SEQ ID NO: 2278) | TARP(V28L)27-35 |
| A*02:01 | FLPSPLFFFL (SEQ ID NO: 2279) | TARP(P5L) 5-13 |
| A*02:01 | GLFKCGIAV (SEQ ID NO: 2280) | FAP 639-647 |
| A*02:01 | GLIQLVEGV (SEQ ID NO: 2281) | TRAG-3 4-12 |
| A*02:01 | ILGVLTSLV (SEQ ID NO: 2282) | DLK1 309-317 |
| A*02:01 | LLVPTCVFLV (SEQ ID NO: 2283) | 691-700 |
| A*02:01 | MLAVFLPIV (SEQ ID NO: 2284) | STEAP 292-300 (293L) |
| A*02:01 | NLFETPVEA (SEQ ID NO: 2285) | 194-202 |
| A*02:01 | QLGEQCWTV (SEQ ID NO: 2286) | PSCA 44-51 (51A) |
| A*02:01 | RLAEYQAYI (SEQ ID NO: 2287) | SART3 309-317 |
| A*02:01 | SIDWFMVTV (SEQ ID NO: 2288) | p31-39 |
| A*02:01 | SILLRDAGLV (SEQ ID NO: 2289) | TRAG-3 57-66 |
| A*02:01 | SLFEPPPPG (SEQ ID NO: 2290) | PSMA 85-93 |
| A*02:01 | SQADALKYV (SEQ ID NO: 2291) | EZH2 729-737 |
| A*02:01 | WLSLKTLLSL (SEQ ID NO: 2292) | Bcl-2 214-223 |
| A*02:01 | YLNRHLHTWI (SEQ ID NO: 2293) | BCL-2 180-189 |
| A*02:01 | YLQWIEFSI (SEQ ID NO: 2294) | Prominin1 744-752 |
| A*02:01 | YLYQWLGAPV (SEQ ID NO: 2295) | Osteocalcin 51-60 |
| A*02:01 | KLMSSNSTDL (SEQ ID NO: 2296) | HSP105 234-243 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| A*02: 01 | RLQGISPKI (SEQ ID NO: 2297) | SSX2 103-111 |
| A*02: 01 | AILALLPALL (SEQ ID NO: 2298) | PSCA |
| A*02: 01 | ALIHHNTHL (SEQ ID NO: 2299) | HER2 466-474 |
| A*02: 01 | CMHLLLEAV (SEQ ID NO: 2300) | MG50 624-632 |
| A*02: 01 | FLIIWQNTM (SEQ ID NO: 2301) | F5P26 |
| A*02: 01 | FLPWHRLFLL (SEQ ID NO: 2302) | Tyrosinase 207-216 |
| A*02: 01 | FVWLHYYSV (SEQ ID NO: 2303) | TRP2 185-193(L) |
| A*02: 01 | GLFGDIYLA (SEQ ID NO: 2304) | CSNK1A1 26-34 |
| A*02: 01 | GLFGDIYLAI (SEQ ID NO: 2305) | CSNK1A1 26-35 |
| A*02: 01 | ILLRDAGLV (SEQ ID NO: 2306) | TRAG-3L 58-66 |
| A*02: 01 | ILLVVVLGV (SEQ ID NO: 2307) | Receptor tyrosine-protein kinase erbB-2 707-715 |
| A*02: 01 | ILNAMIAKI (SEQ ID NO: 2308) | HAUS3 154-162 |
| A*02: 01 | KASEYLQLV (SEQ ID NO: 2309) | MAGEA2 153-161 |
| A*02: 01 | KIWEELSVL (SEQ ID NO: 2310) | MAGEA3 220-228 |
| A*02: 01 | KLIDRTE(S)L (SEQ ID NO: 2311) | LSP1 325-333 |
| A*02: 01 | KLTGDENFTI (SEQ ID NO: 2312) | Tyrosinase precursor 224-233 |
| A*02: 01 | LLCYSCKAQV (SEQ ID NO: 2313) | PSCA 17-26 |
| A*02: 01 | LLLEAVPAV (SEQ ID NO: 2314) | MG50 69-77 |
| A*02: 01 | LLNQLQVNL (SEQ ID NO: 2315) | Mucin2 467-475 |
| A*02: 01 | LLRDAGLVKM (SEQ ID NO: 2316) | TRAP 59-68 |
| A*02: 01 | LLRRYNVAKV (SEQ ID NO: 2317) | SOX11 266-275 |
| A*02: 01 | LLSHGAVIEV (SEQ ID NO: 2318) | Ankyrin NYBR1 158-167 |
| A*02: 01 | LVFGIELMEV (SEQ ID NO: 2319) | MAGEA3 160-169 |
| A*02: 01 | LVFGIEVVEV (SEQ ID NO: 2320) | MAGEA12 160-169 |
| A*02: 01 | MLWGWREHV (SEQ ID NO: 2321) | Mucin2 645-653 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Peptide | Source |
|---|---|---|
| A*02:01 | PLQPEQLQV (SEQ ID NO: 2322) | Receptor tyrosine-protein kinase erbB-2 437-445 |
| A*02:01 | QLMAFNHLI (SEQ ID NO: 2323) | PAX3/FKHR 135-143 |
| A*02:01 | QLMPYGCLL (SEQ ID NO: 2324) | Receptor tyrosine-protein kinase erbB-2 845-853 |
| A*02:01 | RLGPTLMCL (SEQ ID NO: 2325) | MG50 1244-1252 |
| A*02:01 | RLTRFLSRV (SEQ ID NO: 2326) | CyclinD 228-236 |
| A*02:01 | RTF(S)PTYGL (SEQ ID NO: 2327) | Desmuslin 426-434 |
| A*02:01 | SILLRDAGL (SEQ ID NO: 2328) | TRAP 57-65 |
| A*02:01 | SLADEAEVYL (SEQ ID NO: 2329) | GAS7 Neoepitope |
| A*02:01 | SLDDYNHLV (SEQ ID NO: 2330) | L-dopachrome tautomerase 288-296 |
| A*02:01 | SLYKFSPFPL (SEQ ID NO: 2331) | O-linked N-acetylglucosamine transferase FSP06 |
| A*02:01 | SMTR(S)PPRV (SEQ ID NO: 2332) | SFRS2B 241-249 |
| A*02:01 | TLEEITGYL (SEQ ID NO: 2333) | Receptor tyrosine-protein kinase erbB-2 448-456 |
| A*02:01 | TLHCDCEIL (SEQ ID NO: 2334) | MG50 210-218 |
| A*02:01 | VLEPPGARDV (SEQ ID NO: 2335) | BIR 7 230-239 |
| A*02:01 | VLLALLMAGL (SEQ ID NO: 2336) | Prostate stem cell antigen 4-13 |
| A*02:01 | VLSVNVPDV (SEQ ID NO: 2337) | MG50 625-633 |
| A*02:01 | VLVKSPNHV (SEQ ID NO: 2338) | Receptor tyrosine-protein kinase erbB-4 890-898 |
| A*02:01 | VMIG(S)PKKV (SEQ ID NO: 2339) | Tensin3 1558-1566 |
| A*02:01 | VVLGVVFGI (SEQ ID NO: 2340) | Receptor tyrosine-protein kinase erbB-2 743-751 |
| A*02:01 | WLPKILGEV (SEQ ID NO: 2341) | MG50 1051-1059 |
| A*02:01 | WLQYFPNPV (SEQ ID NO: 2342) | Cytochrome P450 246-254 |
| A*02:01 | YLLDLSTNHL (SEQ ID NO: 2343) | Fibromodulin 7-15 |
| A*02:01 | YLWWVNNQSL (SEQ ID NO: 2344) | CEA 176-185 |
| A*02:01 | ALGGHPLLGV (SEQ ID NO: 2345) | Dickkopf-related protein 1 20-29 |
| A*02:01 | ALLAGLVSL (SEQ ID NO: 2346) | FGFR4 676-684 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| MHC Allele | Peptide | Antigen Source |
|---|---|---|
| A*02:01 | ALLTYMIAHI (SEQ ID NO: 2347) | Thymidylate synthase 231-240 |
| A*02:01 | ALMDKSLHV (SEQ ID NO: 2348) | MART-1 56-64 |
| A*02:01 | ALPPPLMLL (SEQ ID NO: 2349) | Heparanase 8-16 |
| A*02:01 | ALSVMGVYV (SEQ ID NO: 2350) | MAGEA9 223-231 |
| A*02:01 | ALVEFEDVL (SEQ ID NO: 2351) | hnRNP L 140-148 |
| A*02:01 | ALWPWLLMA (SEQ ID NO: 2352) | RNF43 11-19 |
| A*02:01 | AMLGTHTMEV (SEQ ID NO: 2353) | Melanocyte-specific secreted glycoprotein 184-193 |
| A*02:01 | AVIGALLAV (SEQ ID NO: 2354) | Melanocyte-specific secreted glycoprotein 20-28 |
| A*02:01 | CLYGNVEKV (SEQ ID NO: 2355) | hnRNP L 404-412 |
| A*02:01 | DLIFGLNAL (SEQ ID NO: 2356) | Heparanase 185-193 |
| A*02:01 | ELFQDLSQL (SEQ ID NO: 2357) | ETV5 54-53 |
| A*02:01 | FAWERVRGL (SEQ ID NO: 2358) | Cyclin-dependent kinase inhibitor 1 97-105 |
| A*02:01 | FIASNGVKLV (SEQ ID NO: 2359) | ACTN4 118-127 (K5N) |
| A*02:01 | FLALIICNA (SEQ ID NO: 2360) | Tubulin beta 4 283-291 |
| A*02:01 | FLDEFMEGV (SEQ ID NO: 2361) | Malic enzyme 224-232 |
| A*02:01 | RMFPNAPYL (SEQ ID NO: 2362) | WT-1 126-134 (Wilms tumor) |
| A*02:01 | RLNMFTPYI (SEQ ID NO: 2363) | Chlamydia trachomatis MOMP 258-266 |
| A*02:01 | NMFTPYIGV (SEQ ID NO: 2364) | MOMP precursor 283-291 |
| A*02:01 | NLVPMVATV (SEQ ID NO: 2365) | HCMV pp65 495-504 |
| A*02:01 | VLEETSVML (SEQ ID NO: 2366) | HCMV IE1 316-324 (UL123) |
| A*02:01 | VLAELVKQI (SEQ ID NO: 2367) | HCMV IE1 81-89 |
| A*02:01 | MLNIPSINV (SEQ ID NO: 2368) | pp65 120-128 |
| A*02:01 | LLLDRLNQL (SEQ ID NO: 2369) | SARS-CoV Nucleocapsid protein 223-231 (conserved in SARS-CoV-2) |
| A*02:01 | FIAGLIAIV (SEQ ID NO: 2370) | SARS-CoV-2 Spike glycoprotein 1220-1228 (confirmed epitope) |
| A*02:01 | ALNTLVKQL (SEQ ID NO: 2371) | SARS-CoV Spike glycoprotein precursor 940-948 (conserved in SARS-CoV-2) |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| A*02: 01 | LITGRLQSL (SEQ ID NO: 2372) | SARS-CoV-2 Spike glycoprotein 996-1004 (confirmed epitope) |
| A*02: 01 | NLNESLIDL (SEQ ID NO: 2373) | SARS-CoV Spike glycoprotein precursor 1174-1182 (conserved in SARS-Cov-2) |
| A*02: 01 | VLNDILSRL (SEQ ID NO: 2374) | SARS-CoV Spike glycoprotein precursor 958-966 (conserved in SARS-Cov-2) |
| A*02: 01 | YLQPRTFLL (SEQ ID NO: 2375) | SARS-Cov-2 Spike glycoprotein 269-277 (confirmed epitope) |
| A*02: 01 | LLYDANYFL (SEQ ID NO: 2376) | SARS-CoV-2 ORF3a 139-147 (confirmed epitope) |
| A*02: 01 | RLQSLQTYV (SEQ ID NO: 2377) | SARS-CoV-2 Spike glycoprotein 1000-1008 (confirmed subdominant epitope) |
| A*02: 01 | KLWAQCVQL (SEQ ID NO: 2378) | SARS-CoV-2 ORF1ab 3886-3894 (confirmed epitope) |
| A*02: 01 | TLYAVATTI (SEQ ID NO: 2379) | Dengue NS4b 40-48 |
| A*02: 01 | KLAEAIFKL (SEQ ID NO: 2380) | Dengue NS5 563-571 |
| A*02: 01 | ILIRTGLLVI (SEQ ID NO: 2381) | Dengue NS2b 97-106 |
| A*02: 01 | AIKRGLRTL (SEQ ID NO: 2382) | Dengue NS3 112-120 |
| A*02: 01 | LLLGLMILL (SEQ ID NO: 2383) | Dengue NS4a 56-64 |
| A*02: 01 | VLLLVTHYA (SEQ ID NO: 2384) | Dengue NS4b 111-119 |
| A*02: 01 | GLCTLVAML (SEQ ID NO: 2385) | EBV BMLF-1 259-267 |
| A*02: 01 | CLGGLLTMV (SEQ ID NO: 2386) | EBV LMP-2 426-434 |
| A*02: 01 | YLLEMLWRL (SEQ ID NO: 2387) | EBV LMP-1 125-133 |
| A*02: 01 | YLQQNWWTL (SEQ ID NO: 2388) | EBV LMP1 159-167 |
| A*02: 01 | YVLDHLIVV (SEQ ID NO: 2389) | EBV BRLF1 109-117 |
| A*02: 01 | FLYALALLL (SEQ ID NO: 2390) | EBV LMP-2 356-364 |
| A*02: 01 | TLDYKPLSV (SEQ ID NO: 2391) | EBV BMRF1 208-216 |
| A*02: 01 | LLDFVRFMGV (SEQ ID NO: 2392) | EBV EBNA-3C 284-293 |
| A*02: 01 | FLDKGTYTL (SEQ ID NO: 2393) | EBV BALF-4 276-284 |
| A*02: 01 | FLPSDFFPSV (SEQ ID NO: 2394) | HBV core antigen 18-27 |
| A*02: 01 | FLLTRILTI (SEQ ID NO: 2395) | HBV envelope 183-191 |
| A*02: 01 | GLSPTVWLSV (SEQ ID NO: 2396) | HBV surface antigen 185-194 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Peptide | Source |
|---|---|---|
| A*02:01 | WLSLLVPFV (SEQ ID NO: 2397) | HBV surface antigen 172-181 |
| A*02:01 | FLLSLGIHL (SEQ ID NO: 2398) | HBV polymerase 573-581 |
| A*02:01 | FLPSDFFPSI (SEQ ID NO: 2399) | HBV core 18-27 (subtype ADR4) |
| A*02:01 | VLHKRTLGL (SEQ ID NO: 2400) | HBV X 92-100 |
| A*02:01 | GLSRYVARL (SEQ ID NO: 2401) | HBV Pol 455-463 |
| A*02:01 | YMDDVVLGA (SEQ ID NO: 2402) | HBV Polymerase 548-556 |
| A*02:01 | KLHLYSHPI (SEQ ID NO: 2403) | HBV Pol 502-510 |
| A*02:01 | ELMTLATWV (SEQ ID NO: 2404) | HBV core protein 64-72 |
| A*02:01 | DLMGYIPAV (SEQ ID NO: 2405) | HCV core 132-140 |
| A*02:01 | CINGVCWTV (SEQ ID NO: 2406) | HCV NS3 1073-1081 |
| A*02:01 | YLLPRRGPRL (SEQ ID NO: 2407) | HCV core 35-44 |
| A*02:01 | VLSDFKTWL (SEQ ID NO: 2408) | HCV NS5a 1987-1995 |
| A*02:01 | ALYDVVTKL (SEQ ID NO: 2409) | HCV NS5b 2594-2602 |
| A*02:01 | KLVALGINAV (SEQ ID NO: 2410) | HCV NS3 1406-1415 |
| A*02:01 | LLFNILGGWV (SEQ ID NO: 2411) | HCV NS4b 1807-1816 |
| A*02:01 | KLSGLGINAV (SEQ ID NO: 2412) | HCV NS3 1406-1415 |
| A*02:01 | DLMGYIPLV (SEQ ID NO: 2413) | HCV core 132-140 |
| A*02:01 | CVNGVCWTV (SEQ ID NO: 2414) | HCV NS3 1073-1081 |
| A*02:01 | GLQDCTMLV (SEQ ID NO: 2415) | HCV NS5B 2727-2735 |
| A*02:01 | SLYNTVATL (SEQ ID NO: 2416) | HIV-1 gag p17 76-84 |
| A*02:01 | ILKEPVHGV (SEQ ID NO: 2417) | HIV-1 RT476-484 |
| A*02:01 | TLNAWVKVV (SEQ ID NO: 2418) | HIV-1 gag p24 19-27 |
| A*02:01 | KLTPLCVTL (SEQ ID NO: 2419) | HIV-1 env gp120 90-98 |
| A*02:01 | GLADQUHL (SEQ ID NO: 2420) | HIV-1 vif 101-109 |
| A*02:01 | LTFGWCFKL (SEQ ID NO: 2421) | HIV-1 nef 137-145 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| A*02: 01 | FLGKIWPS (SEQ ID NO: 2422) | Gag 433-440 |
| A*02: 01 | ALVEMGHHA (SEQ ID NO: 2423) | HIV Vpu 66-74 |
| A*02: 01 | RTLNAWVKV (SEQ ID NO: 2424) | HIV gag 150-158 |
| A*02: 01 | NVWATHACV (SEQ ID NO: 2425) | HIV env gp 67-7 |
| A*02: 01 | SLLNATAIAV (SEQ ID NO: 2426) | HIV env 816-825 |
| A*02: 01 | SLFNTVATL (SEQ ID NO: 2427) | HIV gag 77-85 |
| A*02: 01 | SLVKHHMYI (SEQ ID NO: 2428) | HIV vif 23-31 |
| A*02: 01 | VIYHYVDDL (SEQ ID NO: 2429) | HIV pol |
| A*02: 01 | YMLDLQPETT (SEQ ID NO: 2430) | HPV 16 E7 11-20 |
| A*02: 01 | KLPQLCTEL (SEQ ID NO: 2431) | HPV 16 E6 18-26 |
| A*02: 01 | YMLDLQPET (SEQ ID NO: 2432) | HPV 16 E7 11-19 |
| A*02: 01 | MLDLQPETT (SEQ ID NO: 2433) | HPV 16 E7 12-20 |
| A*02: 01 | VLMIKALEL (SEQ ID NO: 2434) | Non muscle Myosin-9 741-749 |
| A*02: 01 | QLFNHTMFI (SEQ ID NO: 2435) | Non-muscle Myosin 478-486 |
| A*02: 01 | QMARLAWEA (SEQ ID NO: 2436) | 1116-1124 |
| A*02: 01 | LLFGYPVYV (SEQ ID NO: 2437) | Human T-cell lymphotropic virus-1 (HTLV-1) tax 11-19 |
| A*02: 01 | AVLDGLLSL (SEQ ID NO: 2438) | HTLV bZIP factor 42-50 |
| A*02: 01 | GLLSLEEEL (SEQ ID NO: 2439) | bZIP factor 26-34 |
| A*02: 01 | GILGFVFTL (SEQ ID NO: 2440) | Influenza A MP 58-66 |
| A*02: 01 | ILGFVFTLTV (SEQ ID NO: 2441) | Influenza A MP 59-68 |
| A*02: 01 | KLGEFYNQMM (SEQ ID NO: 2442) | Flu BNP 85-94 (Influenza B) |
| A*02: 01 | SITEVECFL (SEQ ID NO: 2443) | VP1 36-44 |
| A*02: 01 | ILMWEAVTL (SEQ ID NO: 2444) | VP1 100-108 |
| A*02: 01 | ALPHIIDEV (SEQ ID NO: 2445) | LCMV envelope gp 10-18 |
| A*02: 01 | YLVSIFLHL (SEQ ID NO: 2446) | LCMV envelope gp 447-455 |

TABLE 5-continued

| Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated. | | |
|---|---|---|
| A*02: 01 | SLNQTVHSL (SEQ ID NO: 2447) | NP 69-77 |
| A*02: 01 | YLNKIQNSL (SEQ ID NO: 2448) | *Plasmodium falciparum* CSP 334-342 |
| A*02: 01 | FIDSYICQV (SEQ ID NO: 2449) | miHAg H-Y (human SMCY) 311-319 |
| A*02: 01 | YIGEVLVSV (SEQ ID NO: 2450) | HA-2 |
| A*02: 01 | VLHDDLLEA (SEQ ID NO: 2451) | Minor Histocompatibility Antigen HA-1 137-145 |
| A*02: 01 | RTLDKVLEV (SEQ ID NO: 2452) | miHAg HA-8 |
| A*02: 01 | NEGATIVE (SEQ ID NO: 2453) | Negative Control |
| A*02: 01 | TMFPHIIVDV (SEQ ID NO: 2454) | Norovirus VP1 139-148 |
| A*02: 01 | LLDVPTAAV (SEQ ID NO: 2455) | Interferon gamma inducible protein (GILT) 30 27-35 |
| A*02: 01 | RILGAVAKV (SEQ ID NO: 2456) | Vinculin 822-830 |
| A*02: 01 | LMWYELSKI (SEQ ID NO: 2457) | KSHVF-8 g6.492-500 |
| A*02: 01 | ILEDIVLTL (SEQ ID NO: 2458) | *Streptococcus pyogenes* Cas9 615-623 |
| A*02: 01 | KMLKEMGEV (SEQ ID NO: 2459) | RSV NP 137-145 |
| A*02: 01 | KLIANNTRV (SEQ ID NO: 2460) | *Mycobacterium bovis* antigen 85-A 200-208 |
| A*02: 01 | GLPVEYLQV (SEQ ID NO: 2461) | *Mycobacterium bovis* antigen 85-A 6-14 |
| A*02: 01 | GILTVSVAV (SEQ ID NO: 2462) | 16 kDa |
| A*02: 01 | AMASTEGNV (SEQ ID NO: 2463) | ESAT-6 |
| A*02: 01 | VLTDGNPPEV (SEQ ID NO: 2464) | 19 kDa |
| A*02: 01 | KVDDTFYYV (SEQ ID NO: 2465) | Vaccinia virus Host range protein 2 74-82 |
| A*02: 01 | ILDDNLYKV (SEQ ID NO: 2466) | Vaccinia virus Copenhagen Protein G5 18-26 |
| A*02: 01 | ALWALPHAA (SEQ ID NO: 2467) | 1E62 593-601 |
| A*02: 01 | RLDDDGNFQL (SEQ ID NO: 2468) | West Nile Virus NY-99 polyprotein precursor (1452-1461) |
| A*02: 01 | ATWAENIQV (SEQ ID NO: 2469) | West Nile virus NY-99 polyprotein precursor 3390-3398 |
| A*02: 01 | YTMDGEYRL (SEQ ID NO: 2470) | West Nile virus NY-99 polyprotein precursor 2023-2031 |
| A*02: 01 | SVGGVFTSV (SEQ ID NO: 2471) | WNV envelope gp 430-438 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| A*02:01 | SLFGQRIEV (SEQ ID NO: 2472) | WNV nonstructural protein 4B 15-23 |
| A*02:01 | LLWNGPMAV (SEQ ID NO: 2473) | NS4B 214-222 |
| A*03:01 | KQSSKALQR (SEQ ID NO: 2474) | bcr-abl 210 kD fusion protein 21-29 |
| A*03:01 | ALLAVGATK (SEQ ID NO: 2475) | gp100 (pmel17) 17-25 |
| A*03:01 | ATGFKQSSK (SEQ ID NO: 2476) | bcr-abl 210 kD fusion protein 259-269 |
| A*03:01 | RISTFKNWPK (SEQ ID NO: 2477) | Survivin-3A 18-27 (27K) |
| A*03:01 | RLGLQVRKNK (SEQ ID NO: 2478) | RhoC 176-185 (1770 |
| A*03:01 | RLLFFAPTR (SEQ ID NO: 2479) | Mcl-1 95-103 |
| A*03:01 | QVLKKIAQK (SEQ ID NO: 2480) | HMOX1 145-153 |
| A*03:01 | RIAAWMATY (SEQ ID NO: 2481) | 165-173 |
| A*03:01 | KLGGALQAK (SEQ ID NO: 2482) | HCMV IE1 184-192 |
| A*03:01 | KTFPPTEPK (SEQ ID NO: 2483) | SARS-CoV-2 Nucleocapsid protein 362-370 (confirmed epitope) |
| A*03:01 | ELERAADVK (SEQ ID NO: 2484) | Dengue NS2b 52-60 |
| A*03:01 | RVSTVQQLTK (SEQ ID NO: 2485) | Dengue C 22-31 |
| A*03:01 | RIEPSWADVK (SEQ ID NO: 2486) | Dengue NS3 64-74 |
| A*03:01 | RVIDPRRCMK (SEQ ID NO: 2487) | Dengue NS3 422-431 |
| A*03:01 | KITAEWLWK (SEQ ID NO: 2488) | Dengue NS5 375-383 |
| A*03:01 | RLRAEAQVK (SEQ ID NO: 2489) | EBV EBNA 3A 603-611 |
| A*03:01 | RVRAYTYSK (SEQ ID NO: 2490) | EBV BRLF1 |
| A*03:01 | RVCEKMALY (SEQ ID NO: 2491) | HCV NS5B 2588-2596 |
| A*03:01 | QVPLRPMTYK (SEQ ID NO: 2492) | HIV-1 nef 73-82 |
| A*03:01 | RLRPGGKKK (SEQ ID NO: 2493) | HIV-1 gag p17 19-27 |
| A*03:01 | AIFQSSMTK (SEQ ID NO: 2494) | HIV pol 325-333 |
| A*03:01 | KLCLRFLSK (SEQ ID NO: 2495) | HPV 33 E6 64-72 |
| A*03:01 | ILRGSVAHK (SEQ ID NO: 2496) | Influenza A (PR8) NP 265-274 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Peptide | Source |
|---|---|---|
| A*11:01 | KTFPPTEPK (SEQ ID NO: 2483) | SARS-CoV-2 Nucleocapsid protein 362-370 (confirmed epitope) |
| A*11:01 | GTSGSPIINR (SEQ ID NO: 2497) | Dengue NS3 serotype 3&4 133-142 |
| A*11:01 | GTSGSPIIDK (SEQ ID NO: 2498) | Dengue NS3 133-142 |
| A*11:01 | GTSGSPIVNR (SEQ ID NO: 2499) | NS3 serotype 1 133-142 |
| A*11:01 | GTSGSPIVDR (SEQ ID NO: 2500) | Dengue NS3 serotype 2 133-142 |
| A*11:01 | GTSGSPIADK (SEQ ID NO: 2501) | Dengue NS3 133-142 |
| A*11:01 | RVSTVQQLTK (SEQ ID NO: 2485) | Dengue C 22-31 |
| A*11:01 | RIEPSWADVK (SEQ ID NO: 2486) | Dengue NS3 64-74 |
| A*11:01 | RVIDPRRCMK (SEQ ID NO: 2487) | Dengue NS3 422-431 |
| A*11:01 | KITAEWLWK (SEQ ID NO: 2488) | Dengue NS5 375-383 |
| A*11:01 | IVTDFSVIK (SEQ ID NO: 2502) | EBV EBNA-4 416-424 |
| A*11:01 | SSCSSCPLSK (SEQ ID NO: 2503) | EBV LMP-2 340-349 |
| A*11:01 | ATIGTAMYK (SEQ ID NO: 2504) | EBV BRLF1 134-142 |
| A*11:01 | AVFDRKSDAK (SEQ ID NO: 2505) | EBNA3B 399-408 |
| A*11:01 | YVNVNMGLK (SEQ ID NO: 2506) | HBV core antigen 88-96 |
| A*11:01 | YVNTNMGLK (SEQ ID NO: 2507) | HBV core 88-96 |
| A*11:01 | STLPETTVVRR (SEQ ID NO: 2508) | HBV core 141-151 |
| A*11:01 | AVDLSHFLK (SEQ ID NO: 2509) | HIV nef 84-92 |
| A*11:01 | ACQGVGGPGHK (SEQ ID NO: 2510) | HIV gag p24 |
| A*11:01 | NTLEQTVKK (SEQ ID NO: 2511) | HPV 33 E6 86-94 |
| A*11:01 | SIIPSGPLK (SEQ ID NO: 2512) | Influenza A MP 13-21 |
| A*11:01 | RMVLASTTAK (SEQ ID NO: 2513) | Influenza A MP1 178-187 |
| A*11:01 | KSMREEYRK (SEQ ID NO: 2514) | Influenza A MP2 70-78 |
| A*24:02 | TYFSLNNKF (SEQ ID NO: 2515) | Adenovirus 5 Hexon 37-45 |
| A*24:02 | TYACFVSNL (SEQ ID NO: 2516) | Carcinogenic Embryonic Antigen (CEA) 652-660 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Peptide | Antigen |
|---|---|---|
| A*24:02 | AFLPWHRLF (SEQ ID NO: 2517) | Tyrosinase 188-196 |
| A*24:02 | IMPKAGLLI (SEQ ID NO: 2518) | MAGE-A3 |
| A*24:02 | VYFFLPDHL (SEQ ID NO: 2519) | gp100-intron 4 (170-178) |
| A*24:02 | EYLQLVFGI (SEQ ID NO: 2520) | MAGEA2 156-164 |
| A*24:02 | TYLPTNASL (SEQ ID NO: 2521) | HER-2/neu 63-71 |
| A*24:02 | VYGFVRACL (SEQ ID NO: 2522) | Telomerase reverse transcriptase (hTRT) 461-469 |
| A*24:02 | TFPDLESEF (SEQ ID NO: 2523) | MAGEA3 97-105 |
| A*24:02 | DYLQYVLQI (SEQ ID NO: 2524) | MiHA ACC1 15-23 |
| A*24:02 | RYCNLEGPPI (SEQ ID NO: 2525) | Lymphocyte antigen 6 complex locus K (LY6K) 177-186 |
| A*24:02 | AYACNTSTL (SEQ ID NO: 2526) | Survivin 80-88 |
| A*24:02 | CYASGWGSI (SEQ ID NO: 2527) | Prostate Specific Antigen-1 153-161 |
| A*24:02 | DYLNEWGSRF (SEQ ID NO: 2528) | CDH3 807-816 |
| A*24:02 | EYCPGGNLF (SEQ ID NO: 2529) | MELK 87-95 (93N) |
| A*24:02 | EYYELFVNI (SEQ ID NO: 2530) | DEP DC1 294-302 |
| A*24:02 | GYCTQIGIF (SEQ ID NO: 2531) | HENMT1 221-229 |
| A*24:02 | IYTWIEDHF (SEQ ID NO: 2532) | FOXM1 262-270 |
| A*24:02 | NYQPVWLCL (SEQ ID NO: 2533) | RNF43 721-729 (722Y) |
| A*24:02 | RYNAQCQETI (SEQ ID NO: 2534) | Midkine 110-119 |
| A*24:02 | EYRALQLHL (SEQ ID NO: 2535) | CA9 219-227 |
| A*24:02 | SYRNEIAYL (SEQ ID NO: 2536) | TTK protein kinase 551-559 |
| A*24:02 | VYLRVRPLL (SEQ ID NO: 2537) | KIF20A 67-75 |
| A*24:02 | VYYNWQYLL (SEQ ID NO: 2538) | IL13r 146-154 |
| A*24:02 | VYALPLKML (SEQ ID NO: 2539) | HCMV pp65 113-121 |
| A*24:02 | QYDPVAALF (SEQ ID NO: 2540) | HCMV pp65 341-349 |
| A*24:02 | AYAQKIFKI (SEQ ID NO: 2541) | CMV 1E-1 248-256 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| MHC | Peptide | Source |
|---|---|---|
| A*24:02 | QYSDRRWCF (SEQ ID NO: 2542) | Dengue NS3 557-565 (Singapore/S275/1990) |
| A*24:02 | TYGPVFMCL (SEQ ID NO: 2543) | EBV LMP-2 419-427 |
| A*24:02 | PYLFWLAAI (SEQ ID NO: 2544) | EBV LMP2 131-139 |
| A*24:02 | TYGPVFMSL (SEQ ID NO: 2545) | EBV LMP2 419-427 |
| A*24:02 | EYLVSFGVW (SEQ ID NO: 2546) | HBV core 117-125 |
| A*24:02 | KYTSFPWLL (SEQ ID NO: 2547) | HBV polymerase 756-764 |
| A*24:02 | FFPSIRDLL (SEQ ID NO: 2548) | HBV core protein 23-31 |
| A*24:02 | AYSQQTRGL (SEQ ID NO: 2549) | HCV NS3 1031-1039 |
| A*24:02 | RYPLTFGWCY (SEQ ID NO: 2550) | HIV-1 Nef 134-143 |
| A*24:02 | RYLKDQQLL (SEQ ID NO: 2551) | HIV-1 gag gp41 67-75 |
| A*24:02 | RYLRDQQLL (SEQ ID NO: 2552) | HIV env |
| A*24:02 | RYPLTFGWCF (SEQ ID NO: 2553) | HIV nef 143-152 |
| A*24:02 | RYPLTFGW (SEQ ID NO: 2554) | HIV nef |
| A*24:02 | VYDFAFRDL (SEQ ID NO: 2555) | HPV16 E6 |
| A*24:02 | SFHSLHLLF (SEQ ID NO: 2556) | HTLV Tax 301-309 |
| A*29:02 | KEKYIDQEEL (SEQ ID NO: 2557) | HSP90 alpha 280-288 (Pathologic Conditions) |
| A*29:02 | LYNTVATLY (SEQ ID NO: 2558) | HIV gag 79-86 |
| A*29:02 | SFDPIPIHY (SEQ ID NO: 2559) | HIV env 216-224 |
| A*29:02 | SFNCRGEFFY (SEQ ID NO: 2560) | HIV env 382-391 |
| A*68:01 | TVSGNILTIR (SEQ ID NO: 2561) | NY-ESO-1 127-136 |
| B*07:02 | VPQYGYLTL (SEQ ID NO: 2562) | AAV2 372-380 |
| B*07:02 | KPYSGTAYNSL (SEQ ID NO: 2563) | Adenovirus Hexon 114-124 |
| B*07:02 | KPYSGTAYNAL (SEQ ID NO: 2564) | Adenovirus Hexon 114-124 |
| B*07:02 | LPLMRKAYL (SEQ ID NO: 2565) | LT antigen 27-35 |
| B*07:02 | LPWHRLFLL (SEQ ID NO: 2566) | Tyrosinase 208-216 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Peptide | Antigen |
|---|---|---|
| B*07: 02 | EPR(PHOSPHO-S)PSHSM (SEQ ID NO: 2567) | Insulin receptor substrate 2 |
| B*07: 02 | TPNQRQNVC (SEQ ID NO: 2568) | P2X5 |
| B*07: 02 | APRGVRMAV (SEQ ID NO: 2569) | LAGE-1 46-54 |
| B*07: 02 | LPVSPRLQL (SEQ ID NO: 2570) | CEACAM 185-193 |
| B*07: 02 | TPRVTGGGAM (SEQ ID NO: 2571) | HCMV pp65 417-426 |
| B*07: 02 | RPHERNGFTVL (SEQ ID NO: 2572) | HCMV pp65 265-275 |
| B*07: 02 | SPRWYFYYL (SEQ ID NO: 2573) | SARS-CoV-2 Nucleocapsid protein 105-113 (confirmed epitope) |
| B*07: 02 | APTRVVAAEM (SEQ ID NO: 2574) | Dengue NS3 serotype 2 222-231 |
| B*07: 02 | RPPIFIRRL (SEQ ID NO: 2575) | EBV EBNA-3A 247-255 |
| B*07: 02 | RPQGGSRPEFVKL (SEQ ID NO: 2576) | EBV BMRF1 116-128 |
| B*07: 02 | QPRAPIRPI (SEQ ID NO: 2577) | EBV EBNA-3C 881-889 |
| B*07: 02 | LPSDFFPSV (SEQ ID NO: 2578) | HBV core 19-27 |
| B*07: 02 | GPRLGVRAT (SEQ ID NO: 2579) | HCV core 41-49 |
| B*07: 02 | DPRRRSRNL (SEQ ID NO: 2580) | HCV core 111-119 |
| B*07: 02 | IPRRIRQGL (SEQ ID NO: 2581) | HIV-1 env gp120 848-856 |
| B*07: 02 | TPGPGVRYPL (SEQ ID NO: 2582) | HIV-1 nef 128-137 |
| B*07: 02 | GPGHKARVL (SEQ ID NO: 2583) | HIV gag p24 223-231 |
| B*07: 02 | KPTLKEYVL (SEQ ID NO: 2584) | HPV 33 E7 5-13 |
| B*07: 02 | LPVSCPEDL (SEQ ID NO: 2585) | bZIP factor 10-18 |
| B*07: 02 | QPEWFRNVL (SEQ ID NO: 2586) | Influenza A PB1 329-337 |
| B*07: 02 | SPIVPSFDM (SEQ ID NO: 2587) | Influenza A NP 473-481 |
| B*07: 02 | SPSVDKARAEL (SEQ ID NO: 2588) | MiHAg SMCY 1041-1051 |
| B*08: 01 | GFKQSSKAL (SEQ ID NO: 2589) | bcr-abl 210 kD fusion protein 19-27 |
| B*08: 01 | ELRRKMMYM (SEQ ID NO: 2590) | 1E1 199-207 |
| B*08: 01 | ELKRKMIYM (SEQ ID NO: 2591) | CMV 1E-1 199-207 (RA Position 3, M/I Position 7) |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Sequence | Source |
|---|---|---|
| B*08:01 | RIKQKGIL (SEQ ID NO: 2592) | Dengue NS3 25-32 |
| B*08:01 | LEKTKKDL (SEQ ID NO: 2593) | Dengue NS4a 6-13 |
| B*08:01 | FLRGRAYGL (SEQ ID NO: 2594) | EBV EBNA-3A 193-201 |
| B*08:01 | RAKFKQLL (SEQ ID NO: 2595) | EBV BZLF-1 190-197 |
| B*08:01 | QAKWRLQTL (SEQ ID NO: 2596) | EBV EBNA3A 158-166 |
| B*08:01 | GLKILQLL (SEQ ID NO: 2597) | HBV external core Ag |
| B*08:01 | HSKKKCDEL (SEQ ID NO: 2598) | HCV NS3 1395-1403 |
| B*08:01 | FLKEKGGL (SEQ ID NO: 2599) | HIV-1 nef 90-97 |
| B*08:01 | GEIYKRWII (SEQ ID NO: 2600) | HIV-1 gag p24 261-269 |
| B*08:01 | ElYKRWII (SEQ ID NO: 2601) | HIV p24 gag 128-135 |
| B*08:01 | YLKDQQLL (SEQ ID NO: 2602) | Env 586-593 |
| B*15:01 | CLIPTAMAF (SEQ ID NO: 2603) | Dengue C 107-115 |
| B*15:01 | RLRPGGKKKY (SEQ ID NO: 2604) | HIV-1 p17 20-29 |
| B*27:05 | GRFGLATEK (SEQ ID NO: 2605) | BRAF594-601 (600E) |
| B*27:05 | GRFGLATVK (SEQ ID NO: 2606) | BRAF594-601 (600V) |
| B*27:05 | RMFPNAPYL (SEQ ID NO: 2362) | WT-1 126-134 (Wilms tumor) |
| B*27:05 | ARKLLLDNL (SEQ ID NO: 2607) | PqqC-like protein 70-78 |
| B*27:05 | NRAKQVIKL (SEQ ID NO: 2608) | Probable ATP-dependent Clp protease ATP-binding subunit 7-15 |
| B*27:05 | QRNAPRITF (SEQ ID NO: 2609) | SARS-CoV-2 Nucleocapsid protein 9-17 (confirmed epitope) |
| B*27:05 | ARMILMTHF (SEQ ID NO: 2610) | HCV NS5B 2841-2849 |
| B*27:05 | KRWIILGLNK (SEQ ID NO: 2611) | HIV-1 gag p24 265-274 |
| B*27:05 | KRWIIMGLNK (SEQ ID NO: 2612) | HIV-1 Gag p24 263-272 |
| B*27:05 | GRAFVTIGK (SEQ ID NO: 2613) | HIV-1 gp100 103-111 |
| B*27:05 | SRYWAIRTR (SEQ ID NO: 2614) | Influenza A NP 383-391 |
| B*35:01 | IPYLDGTFY (SEQ ID NO: 2615) | Adenovirus Hexon |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| B*35: 01 | MPFATPMEA (SEQ ID NO: 2616) | NY-ESO-1 94-102 |
| B*35: 01 | IPSINVHHY (SEQ ID NO: 2617) | HCMV pp65 123-131 |
| B*35: 01 | TPEGIIPTL (SEQ ID NO: 2618) | Dengue NS3 500-508 |
| B*35: 01 | YPLHEQHGM (SEQ ID NO: 2619) | EBV EBNA-3A 458-466 |
| B*35: 01 | EPLPQGQLTAY (SEQ ID NO: 2620) | EBV BZLF-1 54-64 |
| B*35: 01 | HPVAEADYFEY (SEQ ID NO: 2621) | EBV EBNA-1 407-417(4A) |
| B*35: 01 | HPNIEEVAL (SEQ ID NO: 2622) | HCV NS3 1359-1367 |
| B*35: 01 | CPNSSIVY (SEQ ID NO: 2623) | HCV E1 207-214 |
| B*35: 01 | NPDIVIYQY (SEQ ID NO: 2624) | HIV-1 RT330-338 |
| B*35: 01 | NPDIVIYQY (SEQ ID NO: 2625) | HIV-1 HIV-1 RT328-336 |
| B*35: 01 | VPLDEDFRKY (SEQ ID NO: 2626) | HIV-1 HIV-1 RT273-282 |
| B*40: 01 | MEVTPSGTWL (SEQ ID NO: 2627) | SARS-CoV-2 Nucleocapsid protein 322-330 (confirmed epitope) |
| B*40: 01 | GEARKTFVEL (SEQ ID NO: 2628) | Dengue NS3 528-537 |
| B*40: 01 | IEDPPFNSL (SEQ ID NO: 2629) | EBV LMP2 200-208 |
| B*40: 01 | REISVPAEIL (SEQ ID NO: 2630) | HCV NS5a 2266-2275 |
| B*40: 01 | KEKGGLEGL (SEQ ID NO: 2631) | HIV-1 Nef 92-100 |
| C*06: 02 | TRATKMQVI (SEQ ID NO: 2632) | pp65 211-219 |
| C*06: 02 | QIKVRVDM (SEQ ID NO: 2633) | 1E1 88-95 |
| C*06: 02 | TRRFLPQIL (SEQ ID NO: 2634) | NS3 205-213 |
| C*07: 02 | CRVLCCYVL (SEQ ID NO: 2635) | 1E1 309-317 |
| E*01: 01 | VMAPRTLIL (SEQ ID NO: 2636) | HLA-C leader sequence peptide |
| E*01: 01 | VMAPRTLVL (SEQ ID NO: 2637) | HLA-A leader sequence peptide |
| A*01: 01 | SADNNNSEY (SEQ ID NO: 2082) | AAV VP1 492-500 |
| A*01: 01 | TDLGQNLLY (SEQ ID NO: 2083) | Adenovirus 5 Hexon 886-894 |
| A*01: 01 | EADPTGHSY (SEQ ID NO: 2084) | MAGE-A1 161-169 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| A*01: 01 | EVDPIGHLY (SEQ ID NO: 2085) | MAGE-A3 168-176 |
| A*01: 01 | KSDICTDEY (SEQ ID NO: 2086) | Tyrosinase 243-251 (244S) |
| A*01: 01 | KCDICTDEY (SEQ ID NO: 2087) | Tyrosinase 243-251 |
| A*01: 01 | QSLEIISRY (SEQ ID NO: 2088) | Mcl-1 177-185 |
| A*01: 01 | YVDFREYEYY (SEQ ID NO: 2089) | FLT3 ITD |
| A*01: 01 | TLDTLTAFY (SEQ ID NO: 2090) | Mesothelin 429-437 |
| A*01: 01 | LTDDRLFTCY (SEQ ID NO: 2091) | PLEKHM2 |
| A*01: 01 | DSDPDSFQDY (SEQ ID NO: 2092) | Tyr Ala 454-463 |
| A*01: 01 | EADPIGHLY (SEQ ID NO: 2093) | MAGEA3 |
| A*01: 01 | EVDPASNTY (SEQ ID NO: 2094) | MAGE-A4 169-177 |
| A*01: 01 | HSTNGVTRIY (SEQ ID NO: 2095) | PSMA |
| A*01: 01 | ILDTAGREEY (SEQ ID NO: 2096) | N-ras 55-64 |
| A*01: 01 | LVDVMPWLQY (SEQ ID NO: 2097) | Cytochrome P450 240-249 |
| A*01: 01 | RSDSGQQARY (SEQ ID NO: 2098) | AIM-2 |
| A*01: 01 | VTEPGTAQY (SEQ ID NO: 2099) | Minor antigen HA-3T (Lbc oncogene 451-459) |
| A*01: 01 | VYDFFVWLHY (SEQ ID NO: 2100) | TRP-2 181-190 |
| A*01: 01 | YSEHPTFTSQY (SEQ ID NO: 2101) | HCMV pp65 363-373 |
| A*01: 01 | VTEHDTLLY (SEQ ID NO: 2102) | HCMV pp50 245-253 |
| A*01: 01 | FTSDYYQLY (SEQ ID NO: 2103) | SARS-CoV-2 ORF3a 207-215 (confirmed epitope) |
| A*01: 01 | TTDPSFLGRY (SEQ ID NO: 2638) | SARS-CoV-2 Replicase polyprotein 1ab 1637-1646 (confirmed epitope) |
| A*01: 01 | PTDNYITTY (SEQ ID NO: 2639) | SARS-CoV-2 Replicase polyprotein 1ab 1621-1629 (confirmed epitope) |
| A*01: 01 | LLDTASALY (SEQ ID NO: 2106) | HBV core 30-38 |
| A*01: 01 | ATDALMTGY (SEQ ID NO: 2107) | HCV NS3 1435-1443 |
| A*01: 01 | ATDALMTGF (SEQ ID NO: 2108) | HCV NS3 1436-1444 |
| A*01: 01 | CTELKLSDY (SEQ ID NO: 2109) | Influenza A (PR8) NP 44-52 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| MHC allele | Peptide | Antigen source |
|---|---|---|
| A*01:01 | VSDGGPNLY (SEQ ID NO: 2110) | Influenza A PB1 591-599 |
| A*01:01 | IVDCLTEMY (SEQ ID NO: 2111) | DRRFY(1521-1529)) |
| A*0201 | ALCNTDSPL (SEQ ID NO: 2112) | iLR1 |
| A*0201 | ALKDVEERV (SEQ ID NO: 2113) | MAGE-C2 336-344 |
| A*0201 | LLAARAIVAI (SEQ ID NO: 2114) | iLR1 59-68 |
| A*0201 | RLWQELSDI (SEQ ID NO: 2115) | circadian clock protein PASD1 691-700 |
| A*0201 | LLFGLALIEV (SEQ ID NO: 2116) | MAGE-C2 191-200 |
| A*0201 | FLDPRPLTV (SEQ ID NO: 2117) | CYP190 |
| A*0201 | STLCQVEPV (SEQ ID NO: 2118) | MPP11 |
| A*0201 | VLQMKEEDV (SEQ ID NO: 2119) | iLR1 |
| A*0201 | AIQDLCLAV (SEQ ID NO: 2120) | NPM1 |
| A*0201 | QLLIKAVNL (SEQ ID NO: 2121) | MPP11 |
| A*0201 | AIQDLCVAV (SEQ ID NO: 2122) | NPM1 |
| A*0201 | ALTPVVVTL (SEQ ID NO: 2123) | cyclin-dependent kinase 4 170-178 |
| A*02:01 | KLQVFLIVL (SEQ ID NO: 2640) | T1D Diabetes human prepro islet amyloid polypeptide pplAPP 5-13 |
| A*02:01 | VMNILLQYV (SEQ ID NO: 2125) | GAD65 114-123 |
| A*02:01 | SLSRFSWGA (SEQ ID NO: 2126) | Myelin basic protein 110-118 |
| A*02:01 | HLVEALYLV (SEQ ID NO: 2127) | Insulin B chain 10-18 |
| A*02:01 | LNIDLLWSV (SEQ ID NO: 2128) | T1D Diabetes IGRP 228-236 |
| A*02:01 | VLFGLGFAI (SEQ ID NO: 2129) | T1D Diabetes IGRP 265-273 |
| A*02:01 | ALWGPDPAAA (SEQ ID NO: 2130) | Proinsulin precursor 15-24 |
| A*02:01 | MVWESGCTV (SEQ ID NO: 2131) | IA-2 797-805 |
| A*02:01 | YTCPLCRAPV (SEQ ID NO: 2132) | SSA SS-56 55-64 |
| A*02:01 | VIVMLTPLV (SEQ ID NO: 2133) | IA-2 805-813 |
| A*02:01 | AITEVECFL (SEQ ID NO: 2134) | VP1 44-52 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| MHC allele | Peptide | Antigen source |
|---|---|---|
| A*02:01 | FLHCIVFNV (SEQ ID NO: 2135) | large Tantigen 410-418 |
| A*02:01 | LLMWEAVTV (SEQ ID NO: 2136) | VP1 108-116 |
| A*02:01 | CLLPKMDSV (SEQ ID NO: 2137) | large Tantigen 398-406 |
| A*02:01 | FLWGPRALV (SEQ ID NO: 2138) | MAGEA3 271-279 |
| A*02:01 | IMDQVPFSV (SEQ ID NO: 2139) | gp100 (pmel17) 209-217 |
| A*02:01 | YLEPGPVTV (SEQ ID NO: 2140) | gp100 (pmel) 280-288 (288V) |
| A*02:01 | YLSGADLNL (SEQ ID NO: 2141) | Carcinoembryonic antigen (CEA)-derived peptide CAP1-6D |
| A*02:01 | SLLMWITQC (SEQ ID NO: 2142) | NY-ESO-1 157-165 (9C) |
| A*02:01 | KTWGQYWQV (SEQ ID NO: 2143) | gp100 (pmel17) 154-162 |
| A*02:01 | YLEPGPVTA (SEQ ID NO: 2144) | gp100 |
| A*02:01 | YMDGTMSQV (SEQ ID NO: 2145) | Tyrosinase 369-377 (371D) |
| A*02:01 | YLSGANLNL (SEQ ID NO: 2146) | Carcinogenic Embryonic Antigen (CEA) 571-579 |
| A*02:01 | ELAGIGILTV (SEQ ID NO: 2147) | MelanA/MART 26-35 |
| A*02:01 | ILAKFLHWL (SEQ ID NO: 2148) | Telomerase 540-548 |
| A*02:01 | ALQPGTALL (SEQ ID NO: 2149) | Prostate Stem Cell Antigen (PSCA) 14-22 |
| A*02:01 | VISNDVCAQV (SEQ ID NO: 2150) | Prostate Specific Antigen-1 (PSA-1) 154-163 |
| A*02:01 | RLVDDFLLV (SEQ ID NO: 2151) | Telomerase Reverse Transcriptase 865-873 |
| A*02:01 | GVLVGVALI (SEQ ID NO: 2152) | Carcinogenic Embryonic Antigen (CEA) 694-702 |
| A*02:01 | VLYRYGSFSV (SEQ ID NO: 2153) | gp100 (pmel17) 476-485 |
| A*02:01 | PLFQVPEPV (SEQ ID NO: 2154) | Alpha-fetoprotein isoform 1 137-145 |
| A*02:01 | FMNKFIYEI (SEQ ID NO: 2155) | Human alfa fetoprotein 158-166 |
| A*02:01 | GLSPNLNRFL (SEQ ID NO: 2156) | Alpha-fetoprotein isoform 2 167-176 |
| A*02:01 | KVLEYVIKV (SEQ ID NO: 2157) | MAGEA1 278-286 |
| A*02:01 | LLGRNSFEV (SEQ ID NO: 2158) | p53 264-272 |
| A*02:01 | LLLLTVLTV (SEQ ID NO: 2159) | MUC-1 12-20 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| MHC allele | Peptide | Antigen source |
|---|---|---|
| A*02:01 | ILHNGAYSL (SEQ ID NO: 2160) | HER-2/neu 435-443 |
| A*02:01 | RLLQETELV (SEQ ID NO: 2161) | HER-2/neu 689-697 |
| A*02:01 | KIFGSLAFL (SEQ ID NO: 2162) | HER-2/neu 369-377 |
| A*02:01 | LLLLDVAPL (SEQ ID NO: 2163) | HSP1A 459-467 |
| A*02:01 | LLDVAPLSL (SEQ ID NO: 2164) | HSP1A 461-469 |
| A*02:01 | HLYQGCQVV (SEQ ID NO: 2165) | Receptor tyrosine-protein kinase erbB-2 48-56 |
| A*02:01 | HLSTAFARV (SEQ ID NO: 2166) | G250 (renal cell carcinoma) 217-225 |
| A*02:01 | VLQELNVTV (SEQ ID NO: 2167) | Leukocyte Proteinase-3 (Wegener's autoantigen) 169-177 |
| A*02:01 | KVAELVHFL (SEQ ID NO: 2168) | MAGEA3 112-120 |
| A*02:01 | VLAGVGFFI (SEQ ID NO: 2169) | EPHA2 550-558 |
| A*02:01 | FLYTLLREV (SEQ ID NO: 2170) | STEAP 86-94 |
| A*02:01 | ILLWQPIPV (SEQ ID NO: 2171) | Prostatic Acid Phosphatase-3 (PAP-3) 135-143 |
| A*02:01 | RLQEERTCKV (SEQ ID NO: 2172) | BIR |
| A*02:01 | QLCPICRAPV (SEQ ID NO: 2173) | Livin/ML-IAP280 175-184 |
| A*02:01 | VLGEAWRDQV (SEQ ID NO: 2174) | TRAP 45-54 |
| A*02:01 | LLLTVLTVV (SEQ ID NO: 2175) | Tumor Mucin Antigen 13-21 |
| A*02:01 | GLYDGMEHL (SEQ ID NO: 2176) | MAGEA-10 254-262 |
| A*02:01 | SLLMWITQV (SEQ ID NO: 2177) | NY-ESO-1 157-165 |
| A*02:01 | LMLGEFLKL (SEQ ID NO: 2178) | Survivin 96-104 |
| A*02:01 | YLFFYRKSV (SEQ ID NO: 2179) | mTERT 572-580 |
| A*02:01 | ELTLGEFLKL (SEQ ID NO: 2180) | survivin 95-104 |
| A*02:01 | FLTPKKLQCV (SEQ ID NO: 2181) | Prostate Specific Antigen-1 (PSA-1) 141-150 |
| A*02:01 | KLQCVDLHV (SEQ ID NO: 2182) | Prostate Specific Antigen 146-154 |
| A*02:01 | TLAPATEPA (SEQ ID NO: 2183) | Mucin 79-87 |
| A*02:01 | YLQVNSLQTV (SEQ ID NO: 2184) | Telomerase Reverse Transcriptase (hTRT) 988-997 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| MHC allele | Peptide | Antigen source |
|---|---|---|
| A*02:01 | SLGEQQYSV (SEQ ID NO: 2185) | WT1 187-195 |
| A*02:01 | SLEENIVIL (SEQ ID NO: 2186) | RHAMM 275-283 |
| A*02:01 | YMNGTMSQV (SEQ ID NO: 2187) | Tyrosinase 368-376 |
| A*02:01 | ILSLELMKL (SEQ ID NO: 2188) | Receptor for hyaluronic acid-mediated motility (RHAMM) 165-173 |
| A*02:01 | PLFDFSWLSL (SEQ ID NO: 2189) | Bcl-2 208-217 |
| A*02:01 | LLGATCMFV (SEQ ID NO: 2190) | CyclinD 101-109 |
| A*02:01 | ALYVDSLFFL (SEQ ID NO: 2191) | PRAME PRA 300-309 |
| A*02:01 | GLMEEMSAL (SEQ ID NO: 2192) | Human Mena protein (overexpressed in breast cancer) |
| A*02:01 | TMNGSKSPV (SEQ ID NO: 2193) | hMena 502-510 |
| A*02:01 | GVYDGREHTV (SEQ ID NO: 2194) | MAGE-A4 230-239 |
| A*02:01 | YLNDHLEPWI (SEQ ID NO: 2195) | Bcl-X 173-182 |
| A*02:01 | ALDVYNGLL (SEQ ID NO: 2196) | Prostatic acid phosphatase precursor (PAP) 299-307 |
| A*02:01 | ALFDIESKV (SEQ ID NO: 2197) | PSM P2 (prostate) |
| A*02:01 | SLAMLDLLHV (SEQ ID NO: 2198) | Mutant anaplastic lymphoma kinase 1220-1229 |
| A*02:01 | YLNTVQPTCV (SEQ ID NO: 2199) | EGF-R 1138-1147 |
| A*02:01 | KLFGTSGQKT (SEQ ID NO: 2200) | EGF-R-479 350-359 |
| A*02:01 | RMPEAAPPV (SEQ ID NO: 2201) | p53 65-73 |
| A*02:01 | PLTSIISAV (SEQ ID NO: 2202) | Receptor tyrosine-protein kinase erbB-2 728-736 |
| A*02:01 | VLAGGFFLL (SEQ ID NO: 2203) | PSMA 27-38 |
| A*02:01 | LLHETDSAV (SEQ ID NO: 2204) | PSMA/PSM-P1 4-12 |
| A*02:01 | VMAGVGSPYV (SEQ ID NO: 2205) | Receptor tyrosine-protein kinase erbB-2 819-828 |
| A*02:01 | VLPLTVAEV (SEQ ID NO: 2206) | Mesothelin 530-538 |
| A*02:01 | SLLFLLFSL (SEQ ID NO: 2207) | Mesothelin 20-28 |
| A*02:01 | QLFEELQEL (SEQ ID NO: 2208) | Heme oxygenase-1 212-220 |
| A*02:01 | VLDGLDVLL (SEQ ID NO: 2209) | PRAME 100-108 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| MHC allele | Peptide | Antigen source/disease |
|---|---|---|
| A*02: 01 | RLASFYDWPL (SEQ ID NO: 2210) | BIR7 90-99 |
| A*02: 01 | LIAHNQVRQV (SEQ ID NO: 2211) | HER-2/neu (85-94) |
| A*02: 01 | ILHDGAYSL (SEQ ID NO: 2212) | HER-2 434-443 |
| A*02: 01 | FVGEFFTDV (SEQ ID NO: 2213) | GPC3 144-152 (overexpressed in hepatocellular carcinoma) |
| A*02: 01 | LLLIWFRPV (SEQ ID NO: 2214) | BKV Ltag 579-587 |
| A*02: 01 | KLQDASAEV (SEQ ID NO: 2215) | HM1.24-aa 126-134 |
| A*02: 01 | SLYSFPEPEA (SEQ ID NO: 2216) | PRAME |
| A*02: 01 | SLLQHLIGL (SEQ ID NO: 2217) | PRAME 425-433 |
| A*02: 01 | VIFDFLHCI (SEQ ID NO: 2218) | BKV Ltag 406-414 |
| A*02: 01 | VLDFAPPGA (SEQ ID NO: 2219) | WT1 |
| A*02: 01 | TLPGYPPHV (SEQ ID NO: 2220) | PAX-5 311-319 |
| A*02: 01 | YMEHNNVYTV (SEQ ID NO: 2221) | Fibromodulin 250-259 |
| A*02: 01 | YLQHNEIQEV (SEQ ID NO: 2222) | Fibromodulin 206-215 |
| A*02: 01 | SLVDVMPWL (SEQ ID NO: 2223) | Cytochrome p450 161 239-248 |
| A*02: 01 | RLMNDMTAV (SEQ ID NO: 2224) | HSP105 128-136 |
| A*02: 01 | RLARLALVL (SEQ ID NO: 2225) | Trophoblast glycoprotein 17-25 |
| A*02: 01 | FLTGNQLAV (SEQ ID NO: 2226) | 5T4 97-105 |
| A*02: 01 | LLLAGLFSL (SEQ ID NO: 2227) | Fibromodulin 7-15 |
| A*02: 01 | FLGYLILGV (SEQ ID NO: 2228) | Prostatic Acid Phosphatase-3 (PAP-3) |
| A*02: 01 | SLFLGILSV (SEQ ID NO: 2229) | CD20 188-196 (B cell malignancies) |
| A*02: 01 | AVLPLLELV (SEQ ID NO: 2230) | MCL-1 139-147 |
| A*02: 01 | SLSEKTVLL (SEQ ID NO: 2231) | CD59 glycoprotein precursor 106-114 |
| A*02: 01 | YMCSFLFNL (SEQ ID NO: 2232) | Ewing Tumor EZH2 666-674 |
| A*02: 01 | YLISGDSPV (SEQ ID NO: 2233) | CD33 65-73 (1Y2L) |
| A*02: 01 | KASEKIFYV (SEQ ID NO: 2234) | SSX2 41-49 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| A*02:01 | FLAKLNNTV (SEQ ID NO: 2235) | HCA587 317-325 |
| A*02:01 | GLAPPQHLIRV (SEQ ID NO: 2236) | p53 187-197 |
| A*02:01 | VIM PCSWWV (SEQ ID NO: 2237) | Chondromodulin-I 319-327 |
| A*02:01 | KVVEFLAML (SEQ ID NO: 2238) | MAGE-C1 1083-1091 |
| A*02:01 | LTLGEFLKL (SEQ ID NO: 2239) | Survivin-3A 96-104 |
| A*02:01 | ALPFGFILV (SEQ ID NO: 2240) | IL13R 345-353 |
| A*02:01 | TLADFDPRV (SEQ ID NO: 2241) | EphA2 |
| A*02:01 | ALMEQQHYV (SEQ ID NO: 2242) | ITGB8 662-670 |
| A*02:01 | CLTSTVQLV (SEQ ID NO: 2243) | HER-2/neu 789-797 |
| A*02:01 | GLLGASVLGL (SEQ ID NO: 2244) | Telomerase Reverse Transcriptase (hTRT) 674-683 |
| A*02:01 | QLLDGFMITL (SEQ ID NO: 2245) | PASD1 39-48 |
| A*02:01 | YLVGNVCIL (SEQ ID NO: 2246) | PASD1 168-176 |
| A*02:01 | ALLTSRLRFI (SEQ ID NO: 2247) | Telomerase Reverse Transcriptase (hTRT) 615-624 |
| A*02:01 | RLSSCVPVA (SEQ ID NO: 2248) | TGF beta receptor type-2 131-139 |
| A*02:01 | FLYDDNQRV (SEQ ID NO: 2249) | Topoisomerase II-alpha-b 828-836 |
| A*02:01 | YLIELIDRV (SEQ ID NO: 2250) | TACE 250-258 |
| A*02:01 | FLAEDALNTV (SEQ ID NO: 2251) | Epithelial Discoidin Domain Receptor 1 (EDDR1) 867-876 |
| A*02:01 | GLMKYIGEV (SEQ ID NO: 2252) | TRPM8 187-195 |
| A*02:01 | AILALLPAL (SEQ ID NO: 2253) | Prostate Stem Cell Antigen (PSCA) 105-133 |
| A*02:01 | GLQHWVPEL (SEQ ID NO: 2254) | BA46 (Lactadherin) 97-106 |
| A*02:01 | GVRGRVEEI (SEQ ID NO: 2255) | BCR-ABL |
| A*02:01 | ITDQVPFSV (SEQ ID NO: 2256) | gp100 (pmel) 209-217 |
| A*02:01 | KLCPVQLWV (SEQ ID NO: 2257) | p53 139-147 |
| A*02:01 | KVAEELVHFL (SEQ ID NO: 2258) | MAGEA3 112-120 (alternative version) |
| A*02:01 | SLPPPGTRV (SEQ ID NO: 2259) | p53 149-157 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| A*02: 01 | YLGSYGFRL (SEQ ID NO: 2260) | p53 103-111 |
| A*02: 01 | YLQLVFGIEV (SEQ ID NO: 2261) | MAGEA2 157-166 |
| A*02: 01 | TLQDIVYKL (SEQ ID NO: 2262) | BMI1 74-82 |
| A*02: 01 | YAIDLPVSV (SEQ ID NO: 2263) | L-dopachrome tautomerase 488-496 |
| A*02: 01 | AMVGAVLTA (SEQ ID NO: 2264) | Tyrosinase 482-190 |
| A*02: 01 | ATVGIMIGV (SEQ ID NO: 2265) | CEACAM5 687-695 |
| A*02: 01 | YVDPVITSI (SEQ ID NO: 2266) | Hepatocyte growth factor receptor 673-681 |
| A*02: 01 | GVLLWEIFSL (SEQ ID NO: 2267) | VEGFR1 28-37 |
| A*02: 01 | LMAQEALAFL (SEQ ID NO: 2268) | CAMEL 2-11 |
| A*02: 01 | RVA(PHOSPHO-S)PTSGV (SEQ ID NO: 2269) | Insulin receptor substrate-2 1097-1105 |
| A*02: 01 | RVASPTSGV (SEQ ID NO: 2270) | IRS-2 1097-1105 |
| A*02: 01 | ALNVYNGLL (SEQ ID NO: 2271) | ACPP 299-307 |
| A*02: 01 | ALSPVPPVV (SEQ ID NO: 2272) | Bcl-2 85-93 |
| A*02: 01 | ALVCYGPGI (SEQ ID NO: 2273) | FAP alpha 463-471 |
| A*02: 01 | ALWPWLLMAT (SEQ ID NO: 2274) | RNF43 11-20 |
| A*02: 01 | ALYLMELTM (SEQ ID NO: 2275) | CB9L2 |
| A*02: 01 | CLPSPSTPV (SEQ ID NO: 2276) | BMI1 271-279 |
| A*02: 01 | ELSDSLGPV (SEQ ID NO: 2277) | PASD1 695-703 |
| A*02: 01 | FLFLRNFSL (SEQ ID NO: 2278) | TARP(V28L)27-35 |
| A*02: 01 | FLPSPLFFFL (SEQ ID NO: 2279) | TARP(PSL)5-13 |
| A*02: 01 | GLFKCGIAV (SEQ ID NO: 2280) | FAP 639-647 |
| A*02: 01 | GLIQLVEGV (SEQ ID NO: 2281) | TRAG-3 4-12 |
| A*02: 01 | ILGVLTSLV (SEQ ID NO: 2282) | DLK1 309-317 |
| A*02: 01 | LLVPTCVFLV (SEQ ID NO: 2283) | 691-700 |
| A*02: 01 | MLAVFLPIV (SEQ ID NO: 2284) | STEAP 292-300 (293L) |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Peptide | Antigen |
|---|---|---|
| A*02:01 | NLFETPVEA (SEQ ID NO: 2285) | 194-202 |
| A*02:01 | QLGEQCWTV (SEQ ID NO: 2286) | PSCA 44-51 (51A) |
| A*02:01 | RLAEYQAYI (SEQ ID NO: 2287) | SART3 309-317 |
| A*02:01 | SIDWFMVTV (SEQ ID NO: 2288) | p31-39 |
| A*02:01 | SILLRDAGLV (SEQ ID NO: 2289) | TRAG-3 57-66 |
| A*02:01 | SLFEPPPPG (SEQ ID NO: 2290) | PSMA 85-93 |
| A*02:01 | SQADALKYV (SEQ ID NO: 2291) | EZH2 729-737 |
| A*02:01 | WLSLKTLLSL (SEQ ID NO: 2292) | Bcl-2 214-223 |
| A*02:01 | YLNRHLHTWI (SEQ ID NO: 2293) | BCL-2 180-189 |
| A*02:01 | YLQWIEFSI (SEQ ID NO: 2294) | Prominin1 744-752 |
| A*02:01 | YLYQWLGAPV (SEQ ID NO: 2295) | Osteocalcin 51-60 |
| A*02:01 | KLMSSNSTDL (SEQ ID NO: 2296) | HSP105 234-243 |
| A*02:01 | RLQGISPKI (SEQ ID NO: 2297) | SSX2 103-111 |
| A*02:01 | AILALLPALL (SEQ ID NO: 2298) | PSCA |
| A*02:01 | ALIHHNTHL (SEQ ID NO: 2299) | HER2 466-474 |
| A*02:01 | CMHLLLEAV (SEQ ID NO: 2300) | MG50 624-632 |
| A*02:01 | FLIIWQNTM (SEQ ID NO: 2301) | F5P26 |
| A*02:01 | FLPWHRLFLL (SEQ ID NO: 2302) | Tyrosinase 207-216 |
| A*02:01 | FVWLHYYSV (SEQ ID NO: 2303) | TRP2 185-193(L) |
| A*02:01 | GLFGDIYLA (SEQ ID NO: 2304) | CSNK1A1 26-34 |
| A*02:01 | GLFGDIYLAI (SEQ ID NO: 2305) | CSNK1A1 26-35 |
| A*02:01 | ILLRDAGLV (SEQ ID NO: 2306) | TRAG-3L 58-66 |
| A*02:01 | ILLVVVLGV (SEQ ID NO: 2307) | Receptor tyrosine-protein kinase erbB-2 707-715 |
| A*02:01 | ILNAMIAKI (SEQ ID NO: 2308) | HAUS3 154-162 |
| A*02:01 | KASEYLQLV (SEQ ID NO: 2309) | MAGEA2 153-161 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| A*02:01 | KIWEELSVL (SEQ ID NO: 2310) | MAGEA3 220-228 |
| A*02:01 | KLIDRTE(S)L (SEQ ID NO: 2311) | LSP1 325-333 |
| A*02:01 | KLTGDENFTI (SEQ ID NO: 2312) | Tyrosinase precursor 224-233 |
| A*02:01 | LLCYSCKAQV (SEQ ID NO: 2313) | PSCA 17-26 |
| A*02:01 | LLLEAVPAV (SEQ ID NO: 2314) | MG50 69-77 |
| A*02:01 | LLNQLQVNL (SEQ ID NO: 2315) | Mucin2 467-475 |
| A*02:01 | LLRDAGLVKM (SEQ ID NO: 2316) | TRAP 59-68 |
| A*02:01 | LLRRYNVAKV (SEQ ID NO: 2317) | SOX11 266-275 |
| A*02:01 | LLSHGAVIEV (SEQ ID NO: 2318) | Ankyrin NYBR1 158-167 |
| A*02:01 | LVFGIELMEV (SEQ ID NO: 2319) | MAGEA3 160-169 |
| A*02:01 | LVFGIEVVEV (SEQ ID NO: 2320) | MAGEA12 160-169 |
| A*02:01 | MLWGWREHV (SEQ ID NO: 2321) | Mucin2 645-653 |
| A*02:01 | PLQPEQLQV (SEQ ID NO: 2322) | Receptor tyrosine-protein kinase erbB-2 437-445 |
| A*02:01 | QLMAFNHLI (SEQ ID NO: 2323) | PAX3/FKHR 135-143 |
| A*02:01 | QLMPYGCLL (SEQ ID NO: 2324) | Receptor tyrosine-protein kinase erbB-2 845-853 |
| A*02:01 | RLGPTLMCL (SEQ ID NO: 2325) | MG50 1244-1252 |
| A*02:01 | RLTRFLSRV (SEQ ID NO: 2326) | CyclinD 228-236 |
| A*02:01 | RTF(S)PTYGL (SEQ ID NO: 2327) | Desmuslin 426-434 |
| A*02:01 | SILLRDAGL (SEQ ID NO: 2328) | TRAP 57-65 |
| A*02:01 | SLADEAEVYL (SEQ ID NO: 2329) | GAS7 Neoepitope |
| A*02:01 | SLDDYNHLV (SEQ ID NO: 2330) | L-dopachrome tautomerase 288-296 |
| A*02:01 | SLYKFSPFPL (SEQ ID NO: 2331) | O-linked N-acetylglucosamine transferase FSP06 |
| A*02:01 | SMTR(S)PPRV (SEQ ID NO: 2332) | SFRS2B 241-249 |
| A*02:01 | TLEEITGYL (SEQ ID NO: 2333) | Receptor tyrosine-protein kinase erbB-2 448-456 |
| A*02:01 | TLHCDCEIL (SEQ ID NO: 2334) | MG50 210-218 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Peptide | Antigen |
|---|---|---|
| A*02:01 | VLEPPGARDV (SEQ ID NO: 2335) | BIR 7 230-239 |
| A*02:01 | VLLALLMAGL (SEQ ID NO: 2336) | Prostate stem cell antigen 4-13 |
| A*02:01 | VLSVNVPDV (SEQ ID NO: 2337) | MG50 625-633 |
| A*02:01 | VLVKSPNHV (SEQ ID NO: 2338) | Receptor tyrosine-protein kinase erbB-4 890-898 |
| A*02:01 | VMIG(S)PKKV (SEQ ID NO: 2339) | Tensin3 1558-1566 |
| A*02:01 | VVLGVVFGI (SEQ ID NO: 2340) | Receptor tyrosine-protein kinase erbB-2 743-751 |
| A*02:01 | WLPKILGEV (SEQ ID NO: 2341) | MG50 1051-1059 |
| A*02:01 | WLQYFPNPV (SEQ ID NO: 2342) | Cytochrome P450 246-254 |
| A*02:01 | YLLDLSTNHL (SEQ ID NO: 2343) | Fibromodulin 7-15 |
| A*02:01 | YLWWVNNQSL (SEQ ID NO: 2344) | CEA 176-185 |
| A*02:01 | ALGGHPLLGV (SEQ ID NO: 2345) | Dickkopf-related protein 1 20-29 |
| A*02:01 | ALLAGLVSL (SEQ ID NO: 2346) | FGFR4 676-684 |
| A*02:01 | ALLTYMIAHI (SEQ ID NO: 2347) | Thymidylate synthase 231-240 |
| A*02:01 | ALMDKSLHV (SEQ ID NO: 2348) | MART-1 56-64 |
| A*02:01 | ALPPPLMLL (SEQ ID NO: 2349) | Heparanase 8-16 |
| A*02:01 | ALSVMGVYV (SEQ ID NO: 2350) | MAGEA9 223-231 |
| A*02:01 | ALVEFEDVL (SEQ ID NO: 2351) | hnRNP L 140-148 |
| A*02:01 | ALWPWLLMA (SEQ ID NO: 2352) | RNF43 11-19 |
| A*02:01 | AMLGTHTMEV (SEQ ID NO: 2353) | Melanocyte-specific secreted glycoprotein 184-193 |
| A*02:01 | AVIGALLAV (SEQ ID NO: 2354) | Melanocyte-specific secreted glycoprotein 20-28 |
| A*02:01 | CLYGNVEKV (SEQ ID NO: 2355) | hnRNP L 404-412 |
| A*02:01 | DLIFGLNAL (SEQ ID NO: 2356) | Heparanase 185-193 |
| A*02:01 | ELFQDLSQL (SEQ ID NO: 2357) | ETV5 54-53 |
| A*02:01 | FAWERVRGL (SEQ ID NO: 2358) | Cyclin-dependent kinase inhibitor 1 97-105 |
| A*02:01 | FIASNGVKLV (SEQ ID NO: 2359) | ACTN4 118-127 (K5N) |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| A*02: 01 | FLALIICNA (SEQ ID NO: 2360) | Tubulin beta 4 283-291 |
| A*02: 01 | FLDEFMEGV (SEQ ID NO: 2361) | Malic enzyme 224-232 |
| A*02: 01 | RMFPNAPYL (SEQ ID NO: 2362) | WT-1 126-134 (Wilms tumor) |
| A*02: 01 | RLNMFTPYI (SEQ ID NO: 2363) | Chlamydia trachomatis MOMP 258-266 |
| A*02: 01 | NMFTPYIGV (SEQ ID NO: 2364) | MOMP precursor 283-291 |
| A*02: 01 | NLVPMVATV (SEQ ID NO: 2365) | HCMV pp65 495-504 |
| A*02: 01 | VLEETSVML (SEQ ID NO: 2366) | HCMVIE1 316-324 (UL123) |
| A*02: 01 | VLAELVKQI (SEQ ID NO: 2367) | HCMVIE1 81-89 |
| A*02: 01 | MLNIPSINV (SEQ ID NO: 2368) | pp65 120-128 |
| A*02: 01 | LLLDRLNQL (SEQ ID NO: 2369) | SARS-CoV Nucleocapsid protein 223-231 (conserved in SARS-CoV-2) |
| A*02: 01 | FIAGLIAIV (SEQ ID NO: 2370) | SARS-CoV-2 Spike glycoprotein 1220-1228 (confirmed epitope) |
| A*02: 01 | ALNTLVKQL (SEQ ID NO: 2371) | SARS-CoV Spike glycoprotein precursor 940-948 (conserved in SARS-CoV-2) |
| A*02: 01 | LITGRLQSL (SEQ ID NO: 2372) | SARS-CoV-2 Spike glycoprotein 996-1004 (confirmed epitope) |
| A*02: 01 | NLNESLIDL (SEQ ID NO: 2373) | SARS-CoV Spike glycoprotein precursor 1174-1182 (conserved in SARS-Cov-2) |
| A*02: 01 | VLNDILSRL (SEQ ID NO: 2374) | SARS-CoV Spike glycoprotein precursor 958-966 (conserved in SARS-Cov-2) |
| A*02: 01 | YLQPRTFLL (SEQ ID NO: 2375) | SARS-Cov-2 Spike glycoprotein 269-277 (confirmed epitope) |
| A*02: 01 | LLYDANYFL (SEQ ID NO: 2376) | SARS-CoV-2 ORF3a 139-147 (confirmed epitope) |
| A*02: 01 | RLQSLQTYV (SEQ ID NO: 2377) | SARS-CoV-2 Spike glycoprotein 1000-1008 (confirmed subdominant epitope) |
| A*02: 01 | KLWAQCVQL (SEQ ID NO: 2378) | SARS-CoV-2 ORF1ab 3886-3894 (confirmed epitope) |
| A*02: 01 | TLYAVATTI (SEQ ID NO: 2379) | Dengue NS4b 40-48 |
| A*02: 01 | KLAEAIFKL (SEQ ID NO: 2380) | Dengue NS5 563-571 |
| A*02: 01 | ILIRTGLLVI (SEQ ID NO: 2381) | Dengue NS2b 97-106 |
| A*02: 01 | AIKRGLRTL (SEQ ID NO: 2382) | Dengue NS3 112-120 |
| A*02: 01 | LLLGLMILL (SEQ ID NO: 2383) | Dengue NS4a 56-64 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| A*02:01 | VLLLVTHYA (SEQ ID NO: 2384) | Dengue NS4b 111-119 |
| A*02:01 | GLCTLVAML (SEQ ID NO: 2385) | EBV BM LF-1 259-267 |
| A*02:01 | CLGGLLTMV (SEQ ID NO: 2386) | EBV LMP-2 426-434 |
| A*02:01 | YLLEMLWRL (SEQ ID NO: 2387) | EBV LMP-1 125-133 |
| A*02:01 | YLQQNWWTL (SEQ ID NO: 2388) | EBV LMP1 159-167 |
| A*02:01 | YVLDHLIVV (SEQ ID NO: 2389) | EBV BRLF1 109-117 |
| A*02:01 | FLYALALLL (SEQ ID NO: 2390) | EBV LMP-2 356-364 |
| A*02:01 | TLDYKPLSV (SEQ ID NO: 2391) | EBV BMRF1 208-216 |
| A*02:01 | LLDFVRFMGV (SEQ ID NO: 2392) | EBV EBNA-3C 284-293 |
| A*02:01 | FLDKGTYTL (SEQ ID NO: 2393) | EBV BALF-4 276-284 |
| A*02:01 | FLPSDFFPSV (SEQ ID NO: 2394) | HBV core antigen 18-27 |
| A*02:01 | FLLTRILTI (SEQ ID NO: 2395) | HBV envelope 183-191 |
| A*02:01 | GLSPTVWLSV (SEQ ID NO: 2396) | HBV surface antigen 185-194 |
| A*02:01 | WLSLLVPFV (SEQ ID NO: 2397) | HBV surface antigen 172-181 |
| A*02:01 | FLLSLGIHL (SEQ ID NO: 2398) | HBV polymerase 573-581 |
| A*02:01 | FLPSDFFPSI (SEQ ID NO: 2399) | HBV core 18-27 (subtype ADR4) |
| A*02:01 | VLHKRTLGL (SEQ ID NO: 2400) | HBV X 92-100 |
| A*02:01 | GLSRYVARL (SEQ ID NO: 2401) | HBV Pol 455-463 |
| A*02:01 | YMDDVVLGA (SEQ ID NO: 2402) | HBV Polymerase 548-556 |
| A*02:01 | KLHLYSHPI (SEQ ID NO: 2403) | HBV Pol 502-510 |
| A*02:01 | ELMTLATWV (SEQ ID NO: 2404) | HBV core protein 64-72 |
| A*02:01 | DLMGYIPAV (SEQ ID NO: 2405) | HCV core 132-140 |
| A*02:01 | CINGVCWTV (SEQ ID NO: 2406) | HCV NS3 1073-1081 |
| A*02:01 | YLLPRRGPRL (SEQ ID NO: 2407) | HCV core 35-44 |
| A*02:01 | VLSDFKTWL (SEQ ID NO: 2408) | HCV NS5a 1987-1995 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| A*02: 01 | ALYDVVTKL (SEQ ID NO: 2409) | HCV NS5b 2594-2602 |
| A*02: 01 | KLVALGINAV (SEQ ID NO: 2410) | HCV NS3 1406-1415 |
| A*02: 01 | LLFNILGGWV (SEQ ID NO: 2411) | HCV NS4b 1807-1816 |
| A*02: 01 | KLSGLGINAV (SEQ ID NO: 2412) | HCV NS3 1406-1415 |
| A*02: 01 | DLMGYIPLV (SEQ ID NO: 2413) | HCV core 132-140 |
| A*02: 01 | CVNGVCWTV (SEQ ID NO: 2414) | HCV NS3 1073-1081 |
| A*02: 01 | GLQDCTMLV (SEQ ID NO: 2415) | HCV NS5B 2727-2735 |
| A*02: 01 | SLYNTVATL (SEQ ID NO: 416) | HIV-1 gag p17 76-84 |
| A*02: 01 | ILKEPVHGV (SEQ ID NO: 2417) | HIV-1 RT476-484 |
| A*02: 01 | TLNAWVKVV (SEQ ID NO: 2418) | HIV-1 gag p24 19-27 |
| A*02: 01 | KLTPLCVTL (SEQ ID NO: 2419) | HIV-1 env gp120 90-98 |
| A*02: 01 | GLADQUHL (SEQ ID NO: 2420) | HIV-1 vif 101-109 |
| A*02: 01 | LTFGWCFKL (SEQ ID NO: 2421) | HIV-1 nef 137-145 |
| A*02: 01 | FLGKIWPS (SEQ ID NO: 2422) | Gag 433-440 |
| A*02: 01 | ALVEMGHHA (SEQ ID NO: 2423) | HIV Vpu 66-74 |
| A*02: 01 | RTLNAWVKV (SEQ ID NO: 2424) | HIV gag 150-158 |
| A*02: 01 | NVWATHACV (SEQ ID NO: 2425) | HIV env gp 67-7 |
| A*02: 01 | SLLNATAIAV (SEQ ID NO: 2426) | HIV env 816-825 |
| A*02: 01 | SLFNTVATL (SEQ ID NO: 2427) | HIV gag 77-85 |
| A*02: 01 | SLVKHHMYI (SEQ ID NO: 2428) | HIV vif 23-31 |
| A*02: 01 | VIYHYVDDL (SEQ ID NO: 2429) | HIV pol |
| A*02: 01 | YMLDLQPETT (SEQ ID NO: 2430) | HPV 16 E7 11-20 |
| A*02: 01 | KLPQLCTEL (SEQ ID NO: 2431) | HPV 16 E6 18-26 |
| A*02: 01 | YMLDLQPET (SEQ ID NO: 2432) | HPV 16 E7 11-19 |
| A*02: 01 | MLDLQPETT (SEQ ID NO: 2433) | HPV 16 E7 12-20 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Peptide | Antigen |
|---|---|---|
| A*02:01 | VLMIKALEL (SEQ ID NO: 2434) | Non muscle Myosin-9 741-749 |
| A*02:01 | QLFNHTMFI (SEQ ID NO: 2435) | Non-muscle Myosin 478-486 |
| A*02:01 | QMARLAWEA (SEQ ID NO: 2436) | 1116-1124 |
| A*02:01 | LLFGYPVYV (SEQ ID NO: 2437) | Human T-cell lymphotropic virus-1 (HTLV-1) tax 11-19 |
| A*02:01 | AVLDGLLSL (SEQ ID NO: 2438) | HTLV bZIP factor 42-50 |
| A*02:01 | GLLSLEEEL (SEQ ID NO: 2439) | bZIP factor 26-34 |
| A*02:01 | GILGFVFTL (SEQ ID NO: 2440) | Influenza A MP 58-66 |
| A*02:01 | ILGFVFTLTV (SEQ ID NO: 2441) | Influenza A MP 59-68 |
| A*02:01 | KLGEFYNQMM (SEQ ID NO: 2442) | Flu BNP 85-94 (Influenza B) |
| A*02:01 | SITEVECFL (SEQ ID NO: 2443) | VP1 36-44 |
| A*02:01 | ILMWEAVTL (SEQ ID NO: 2444) | VP1 100-108 |
| A*02:01 | ALPHIIDEV (SEQ ID NO: 2445) | LCMV envelope gp 10-18 |
| A*02:01 | YLVSIFLHL (SEQ ID NO: 2446) | LCMV envelope gp 447-455 |
| A*02:01 | SLNQTVHSL (SEQ ID NO: 2447) | NP 69-77 |
| A*02:01 | YLNKIQNSL (SEQ ID NO: 2448) | *Plasmodium falciparum* CSP 334-342 |
| A*02:01 | FIDSYICQV (SEQ ID NO: 2449) | miHAg H-Y (human SMCY) 311-319 |
| A*02:01 | YIGEVLVSV (SEQ ID NO: 2450) | HA-2 |
| A*02:01 | VLHDDLLEA (SEQ ID NO: 2451) | Minor Histocompatibility Antigen HA-1 137-145 |
| A*02:01 | RTLDKVLEV (SEQ ID NO: 2452) | miHAg HA-8 |
| A*02:01 | NEGATIVE (SEQ ID NO: 2453) | Negative Control |
| A*02:01 | TMFPHIIVDV (SEQ ID NO: 2454) | Norovirus VP1 139-148 |
| A*02:01 | LLDVPTAAV (SEQ ID NO: 2455) | Interferon gamma inducible protein (GILT) 30 27-35 |
| A*02:01 | RILGAVAKV (SEQ ID NO: 2456) | Vinculin 822-830 |
| A*02:01 | LMWYELSKI (SEQ ID NO: 2457) | KSHVF-8 g6.492-500 |
| A*02:01 | ILEDIVLTL (SEQ ID NO: 2458) | *Streptococcus pyogenes* Cas9 615-623 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| MHC allele | Peptide | Antigen source / disease |
|---|---|---|
| A*02:01 | KMLKEMGEV (SEQ ID NO: 2459) | RSV NP 137-145 |
| A*02:01 | KLIANNTRV (SEQ ID NO: 2460) | *Mycobacterium bovis* antigen 85-A 200-208 |
| A*02:01 | GLPVEYLQV (SEQ ID NO: 2461) | *Mycobacterium bovis* antigen 85-A 6-14 |
| A*02:01 | GILTVSVAV (SEQ ID NO: 2462) | 16 kDa |
| A*02:01 | AMASTEGNV (SEQ ID NO: 2463) | ESAT-6 |
| A*02:01 | VLTDGNPPEV (SEQ ID NO: 2464) | 19 kDa |
| A*02:01 | KVDDTFYYV (SEQ ID NO: 2465) | Vaccinia virus Host range protein 2 74-82 |
| A*02:01 | ILDDNLYKV (SEQ ID NO: 2466) | Vaccinia virus Copenhagen Protein G5 18-26 |
| A*02:01 | ALWALPHAA (SEQ ID NO: 2467) | 1E62 593-601 |
| A*02:01 | RLDDDGNFQL (SEQ ID NO: 2468) | West Nile Virus NY-99 polyprotein precursor (1452-1461) |
| A*02:01 | ATWAENIQV (SEQ ID NO: 2469) | West Nile virus NY-99 polyprotein precursor 3390-3398 |
| A*02:01 | YTMDGEYRL (SEQ ID NO: 2470) | West Nile virus NY-99 polyprotein precursor 2023-2031 |
| A*02:01 | SVGGVFTSV (SEQ ID NO: 2471) | WNV envelope gp 430-438 |
| A*02:01 | SLFGQRIEV (SEQ ID NO: 2472) | WNV nonstructural protein 4B 15-23 |
| A*02:01 | LLWNGPMAV (SEQ ID NO: 2473) | NS4B 214-222 |
| A*03:01 | KQSSKALQR (SEQ ID NO: 2474) | bcr-abl 210 kD fusion protein 21-29 |
| A*03:01 | ALLAVGATK (SEQ ID NO: 2475) | gp100 (pmel17) 17-25 |
| A*03:01 | ATGFKQSSK (SEQ ID NO: 2476) | bcr-abl 210 kD fusion protein 259-269 |
| A*03:01 | RISTFKNWPK (SEQ ID NO: 2477) | Survivin-3A 18-27 (27K) |
| A*03:01 | RLGLQVRKNK (SEQ ID NO: 2478) | RhoC 176-185 (1770 |
| A*03:01 | RLLFFAPTR (SEQ ID NO: 2479) | Mcl-1 95-103 |
| A*03:01 | QVLKKIAQK (SEQ ID NO: 2480) | HMOX1 145-153 |
| A*03:01 | RIAAWMATY (SEQ ID NO: 2481) | 165-173 |
| A*03:01 | KLGGALQAK (SEQ ID NO: 2482) | HCMVIE1 184-192 |
| A*03:01 | KTFPPTEPK (SEQ ID NO: 2483) | SARS-CoV-2 Nucleocapsid protein 362-370 (confirmed epitope) |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Peptide | Source |
|---|---|---|
| A*03:01 | ELERAADVK (SEQ ID NO: 2484) | Dengue NS2b 52-60 |
| A*03:01 | RVSTVQQLTK (SEQ ID NO: 2485) | Dengue C 22-31 |
| A*03:01 | RIEPSWADVK (SEQ ID NO: 2486) | Dengue NS3 64-74 |
| A*03:01 | RVIDPRRCMK (SEQ ID NO: 2487) | Dengue NS3 422-431 |
| A*03:01 | KITAEWLWK (SEQ ID NO: 2488) | Dengue NS5 375-383 |
| A*03:01 | RLRAEAQVK (SEQ ID NO: 2489) | EBV EBNA 3A 603-611 |
| A*03:01 | RVRAYTYSK (SEQ ID NO: 2490) | EBV BRLF1 |
| A*03:01 | RVCEKMALY (SEQ ID NO: 2491) | HCV NS5B 2588-2596 |
| A*03:01 | QVPLRPMTYK (SEQ ID NO: 2492) | HIV-1 nef 73-82 |
| A*03:01 | RLRPGGKKK (SEQ ID NO: 2493) | HIV-1 gag p17 19-27 |
| A*03:01 | AIFQSSMTK (SEQ ID NO: 2494) | HIV pol 325-333 |
| A*03:01 | KLCLRFLSK (SEQ ID NO: 2495) | HPV 33 E6 64-72 |
| A*03:01 | ILRGSVAHK (SEQ ID NO: 2496) | Influenza A (PR8) NP 265-274 |
| A*11:01 | KTFPPTEPK (SEQ ID NO: 2483) | SARS-CoV-2 Nucleocapsid protein 362-370 (confirmed epitope) |
| A*11:01 | GTSGSPIINR (SEQ ID NO: 2497) | Dengue NS3 serotype 3&4 133-142 |
| A*11:01 | GTSGSPIIDK (SEQ ID NO: 2498) | Dengue NS3 133-142 |
| A*11:01 | GTSGSPIVNR (SEQ ID NO: 2499) | NS3 serotype 1 133-142 |
| A*11:01 | GTSGSPIVDR (SEQ ID NO: 2500) | Dengue NS3 serotype 2 133-142 |
| A*11:01 | GTSGSPIADK (SEQ ID NO: 2501) | Dengue NS3 133-142 |
| A*11:01 | RVSTVQQLTK (SEQ ID NO: 2485) | Dengue C 22-31 |
| A*11:01 | RIEPSWADVK (SEQ ID NO: 2486) | Dengue NS3 64-74 |
| A*11:01 | RVIDPRRCMK (SEQ ID NO: 2487) | Dengue NS3 422-431 |
| A*11:01 | KITAEWLWK (SEQ ID NO: 2488) | Dengue NS5 375-383 |
| A*11:01 | IVTDFSVIK (SEQ ID NO: 2502) | EBV EBNA-4 416-424 |
| A*11:01 | SSCSSCPLSK (SEQ ID NO: 2503) | EBV LMP-2 340-349 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Peptide | Antigen |
|---|---|---|
| A*11:01 | ATIGTAMYK (SEQ ID NO: 2504) | EBV BRLF1 134-142 |
| A*11:01 | AVFDRKSDAK (SEQ ID NO: 2505) | EBNA3B 399-408 |
| A*11:01 | YVNVNMGLK (SEQ ID NO: 2506) | HBV core antigen 88-96 |
| A*11:01 | YVNTNMGLK (SEQ ID NO: 2507) | HBV core 88-96 |
| A*11:01 | STLPETTVVRR (SEQ ID NO: 2508) | HBV core 141-151 |
| A*11:01 | AVDLSHFLK (SEQ ID NO: 2509) | HIV nef 84-92 |
| A*11:01 | ACQGVGGPGHK (SEQ ID NO: 2510) | HIV gag p24 |
| A*11:01 | NTLEQTVKK (SEQ ID NO: 2511) | HPV 33 E6 86-94 |
| A*11:01 | SIIPSGPLK (SEQ ID NO: 2512) | Influenza A MP 13-21 |
| A*11:01 | RMVLASTTAK (SEQ ID NO: 2513) | Influenza A MP1 178-187 |
| A*11:01 | KSMREEYRK (SEQ ID NO: 2514) | Influenza A MP2 70-78 |
| A*24:02 | TYFSLNNKF (SEQ ID NO: 2515) | Adenovirus 5 Hexon 37-45 |
| A*24:02 | TYACFVSNL (SEQ ID NO: 2516) | Carcinogenic Embryonic Antigen (CEA) 652-660 |
| A*24:02 | AFLPWHRLF (SEQ ID NO: 2517) | Tyrosinase 188-196 |
| A*24:02 | IMPKAGLLI (SEQ ID NO: 2518) | MAGE-A3 |
| A*24:02 | VYFFLPDHL (SEQ ID NO: 2519) | gp100-intron 4 (170-178) |
| A*24:02 | EYLQLVFGI (SEQ ID NO: 2520) | MAGEA2 156-164 |
| A*24:02 | TYLPTNASL (SEQ ID NO: 2521) | HER-2/neu 63-71 |
| A*24:02 | VYGFVRACL (SEQ ID NO: 2522) | Telomerase reverse transcriptase (hTRT) 461-469 |
| A*24:02 | TFPDLESEF (SEQ ID NO: 2523) | MAGEA3 97-105 |
| A*24:02 | DYLQYVLQI (SEQ ID NO: 2524) | MiHA ACC1 15-23 |
| A*24:02 | RYCNLEGPPI (SEQ ID NO: 2525) | Lymphocyte antigen 6 complex locus K (LY6K) 177-186 |
| A*24:02 | AYACNTSTL (SEQ ID NO: 2526) | Survivin 80-88 |
| A*24:02 | CYASGWGSI (SEQ ID NO: 2527) | Prostate Specific Antigen-1 153-161 |
| A*24:02 | DYLNEWGSRF (SEQ ID NO: 2528) | CDH3 807-816 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| A*24: 02 | EYCPGGNLF (SEQ ID NO: 2529) | MELK 87-95 (93N) |
| A*24: 02 | EYYELFVNI (SEQ ID NO: 2530) | DEP DC1 294-302 |
| A*24: 02 | GYCTQIGIF (SEQ ID NO: 2531) | HENMT1 221-229 |
| A*24: 02 | IYTWIEDHF (SEQ ID NO: 2532) | FOXM1 262-270 |
| A*24: 02 | NYQPVWLCL (SEQ ID NO: 2533) | RNF43 721-729 (722Y) |
| A*24: 02 | RYNAQCQETI (SEQ ID NO: 2534) | Midkine 110-119 |
| A*24: 02 | EYRALQLHL (SEQ ID NO: 2535) | CA9 219-227 |
| A*24: 02 | SYRNEIAYL (SEQ ID NO: 2536) | TTK protein kinase 551-559 |
| A*24: 02 | VYLRVRPLL (SEQ ID NO: 2537) | KIF20A 67-75 |
| A*24: 02 | VYYNWQYLL (SEQ ID NO: 2538) | IL13r 146-154 |
| A*24: 02 | VYALPLKML (SEQ ID NO: 2539) | HCMV pp65 113-121 |
| A*24: 02 | QYDPVAALF (SEQ ID NO: 2540) | HCMV pp65 341-349 |
| A*24: 02 | AYAQKIFKI (SEQ ID NO: 2541) | CMV 1E-1 248-256 |
| A*24: 02 | QYSDRRWCF (SEQ ID NO: 2542) | Dengue NS3 557-565 (Singapore/S275/1990) |
| A*24: 02 | TYGPVFMCL (SEQ ID NO: 2543) | EBV LMP-2 419-427 |
| A*24: 02 | PYLFWLAAI (SEQ ID NO: 2544) | EBV LMP2 131-139 |
| A*24: 02 | TYGPVFMSL (SEQ ID NO: 2545) | EBV LMP2 419-427 |
| A*24: 02 | EYLVSFGVW (SEQ ID NO: 2546) | HBV core 117-125 |
| A*24: 02 | KYTSFPWLL (SEQ ID NO: 2547) | HBV polymerase 756-764 |
| A*24: 02 | FFPSIRDLL (SEQ ID NO: 2548) | HBV core protein 23-31 |
| A*24: 02 | AYSQQTRGL (SEQ ID NO: 2549) | HCV NS3 1031-1039 |
| A*24: 02 | RYPLTFGWCY (SEQ ID NO: 2550) | HIV-1 Nef 134-143 |
| A*24: 02 | RYLKDQQLL (SEQ ID NO: 2551) | HIV-1 gag gp41 67-75 |
| A*24: 02 | RYLRDQQLL (SEQ ID NO: 2552) | HIV env |
| A*24: 02 | RYPLTFGWCF (SEQ ID NO: 2553) | HIV nef 143-152 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Sequence | Antigen |
|---|---|---|
| A*24:02 | RYPLTFGW (SEQ ID NO: 2554) | HIV nef |
| A*24:02 | VYDFAFRDL (SEQ ID NO: 2555) | HPV16 E6 |
| A*24:02 | SFHSLHLLF (SEQ ID NO: 2556) | HTLV Tax 301-309 |
| A*29:02 | KEKYIDQEEL (SEQ ID NO: 2557) | HSP90 alpha 280-288 (Pathologic Conditions) |
| A*29:02 | LYNTVATLY (SEQ ID NO: 2558) | HIV gag 79-86 |
| A*29:02 | SFDPIPIHY (SEQ ID NO: 2559) | HIV env 216-224 |
| A*29:02 | SFNCRGEFFY (SEQ ID NO: 2560) | HIV env 382-391 |
| A*68:01 | TVSGNILTIR (SEQ ID NO: 2561) | NY-ESO-1 127-136 |
| B*07:02 | VPQYGYLTL (SEQ ID NO: 2562) | AAV2 372-380 |
| B*07:02 | KPYSGTAYNSL (SEQ ID NO: 2563) | Adenovirus Hexon 114-124 |
| B*07:02 | KPYSGTAYNAL (SEQ ID NO: 2564) | Adenovirus Hexon 114-124 |
| B*07:02 | LPLMRKAYL (SEQ ID NO: 2565) | LT antigen 27-35 |
| B*07:02 | LPWHRLFLL (SEQ ID NO: 2566) | Tyrosinase 208-216 |
| B*07:02 | EPR(PHOSPHO-S)PSHSM (SEQ ID NO: 2567) | Insulin receptor substrate 2 |
| B*07:02 | TPNQRQNVC (SEQ ID NO: 2568) | P2X5 |
| B*07:02 | APRGVRMAV (SEQ ID NO: 2569) | LAGE-1 46-54 |
| B*07:02 | LPVSPRLQL (SEQ ID NO: 2570) | CEACAM 185-193 |
| B*07:02 | TPRVTGGGAM (SEQ ID NO: 2571) | HCMV pp65 417-426 |
| B*07:02 | RPHERNGFTVL (SEQ ID NO: 2572) | HCMV pp65 265-275 |
| B*07:02 | SPRWYFYYL (SEQ ID NO: 2573) | SARS-CoV-2 Nucleocapsid protein 105-113 (confirmed epitope) |
| B*07:02 | APTRVVAAEM (SEQ ID NO: 2574) | Dengue NS3 serotype 2 222-231 |
| B*07:02 | RPPIFIRRL (SEQ ID NO: 2575) | EBV EBNA-3A 247-255 |
| B*07:02 | RPQGGSRPEFVKL (SEQ ID NO: 2576) | EBV BMRF1 116-128 |
| B*07:02 | QPRAPIRPI (SEQ ID NO: 2577) | EBV EBNA-3C 881-889 |
| B*07:02 | LPSDFFPSV (SEQ ID NO: 2578) | HBV core 19-27 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | | |
|---|---|---|---|
| B*07: 02 | GPRLGVRAT (SEQ ID NO: 2579) | | HCV core 41-49 |
| B*07: 02 | DPRRRSRNL (SEQ ID NO: 2580) | | HCV core 111-119 |
| B*07: 02 | IPRRIRQGL (SEQ ID NO: 2581) | | HIV-1 env gp120 848-856 |
| B*07: 02 | TPGPGVRYPL (SEQ ID NO: 2582) | | HIV-1 nef 128-137 |
| B*07: 02 | GPGHKARVL (SEQ ID NO: 2583) | | HIV gag p24 223-231 |
| B*07: 02 | KPTLKEYVL (SEQ ID NO: 2584) | | HPV 33 E7 5-13 |
| B*07: 02 | LPVSCPEDL (SEQ ID NO: 2585) | | bZIP factor 10-18 |
| B*07: 02 | QPEWFRNVL (SEQ ID NO: 2586) | | Influenza A PB1 329-337 |
| B*07: 02 | SPIVPSFDM (SEQ ID NO: 2587) | | Influenza A NP 473-481 |
| B*07: 02 | SPSVDKARAEL (SEQ ID NO: 2588) | | MiHAg SMCY 1041-1051 |
| B*08: 01 | GFKQSSKAL (SEQ ID NO: 2589) | | bcr-abl 210 kD fusion protein 19-27 |
| B*08: 01 | ELRRKMMYM (SEQ ID NO: 2590) | | 1E1 199-207 |
| B*08: 01 | ELKRKMIYM (SEQ ID NO: 2591) | | CMV 1E-1 199-207 (RA Position 3, M/I Position 7) |
| B*08: 01 | RIKQKGIL (SEQ ID NO: 2592) | | Dengue NS3 25-32 |
| B*08: 01 | LEKTKKDL (SEQ ID NO: 2593) | | Dengue NS4a 6-13 |
| B*08: 01 | FLRGRAYGL (SEQ ID NO: 2594) | | EBV EBNA-3A 193-201 |
| B*08: 01 | RAKFKQLL (SEQ ID NO: 2595) | | EBV BZLF-1 190-197 |
| B*08: 01 | QAKWRLQTL (SEQ ID NO: 2596) | | EBV EBNA3A 158-166 |
| B*08: 01 | GLKILQLL (SEQ ID NO: 2597) | | HBV external core Ag |
| B*08: 01 | HSKKKCDEL (SEQ ID NO: 2598) | | HCV NS3 1395-1403 |
| B*08: 01 | FLKEKGGL (SEQ ID NO: 2599) | | HIV-1 nef 90-97 |
| B*08: 01 | GEIYKRWII (SEQ ID NO: 2600) | | HIV-1 gag p24 261-269 |
| B*08: 01 | ElYKRWII (SEQ ID NO: 2601) | | HIV p24 gag 128-135 |
| B*08: 01 | YLKDQQLL (SEQ ID NO: 2602) | | Env 586-593 |
| B*15: 01 | CLIPTAMAF (SEQ ID NO: 2603) | | Dengue C 107-115 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Peptide | Antigen |
|---|---|---|
| B*15:01 | RLRPGGKKY (SEQ ID NO: 2604) | HIV-1 p17 20-29 |
| B*27:05 | GRFGLATEK (SEQ ID NO: 2605) | BRAF 594-601 (600E) |
| B*27:05 | GRFGLATVK (SEQ ID NO: 2606) | BRAF594-601 (600V) |
| B*27:05 | RMFPNAPYL (SEQ ID NO: 2362) | WT-1 126-134 (Wilms tumor) |
| B*27:05 | ARKLLLDNL (SEQ ID NO: 2607) | PqqC-like protein 70-78 |
| B*27:05 | NRAKQVIKL (SEQ ID NO: 2608) | Probable ATP-dependent Clp protease ATP-binding subunit 7-15 |
| B*27:05 | QRNAPRITF (SEQ ID NO: 2609) | SARS-CoV-2 Nucleocapsid protein 9-17 (confirmed epitope) |
| B*27:05 | ARMILMTHF (SEQ ID NO: 2610) | HCV NS5B 2841-2849 |
| B*27:05 | KRWIILGLNK (SEQ ID NO: 2611) | HIV-1 gag p24 265-274 |
| B*27:05 | KRWIIMGLNK (SEQ ID NO: 2612) | HIV-1 Gag p24 263-272 |
| B*27:05 | GRAFVTIGK (SEQ ID NO: 2613) | HIV-1 gp100 103-111 |
| B*27:05 | SRYWAIRTR (SEQ ID NO: 2614) | Influenza A NP 383-391 |
| B*35:01 | IPYLDGTFY (SEQ ID NO: 2615) | Adenovirus Hexon |
| B*35:01 | MPFATPMEA (SEQ ID NO: 2616) | NY-ESO-1 94-102 |
| B*35:01 | IPSINVHHY (SEQ ID NO: 2617) | HCMV pp65 123-131 |
| B*35:01 | TPEGIIPTL (SEQ ID NO: 2618) | Dengue NS3 500-508 |
| B*35:01 | YPLHEQHGM (SEQ ID NO: 2619) | EBV EBNA-3A 458-466 |
| B*35:01 | EPLPQGQLTAY (SEQ ID NO: 2620) | EBV BZLF-1 54-64 |
| B*35:01 | HPVAEADYFEY (SEQ ID NO: 2621) | EBV EBNA-1 407-417(4A) |
| B*35:01 | HPNIEEVAL (SEQ ID NO: 2622) | HCV NS3 1359-1367 |
| B*35:01 | CPNSSIVY (SEQ ID NO: 2623) | HCV E1 207-214 |
| B*35:01 | NPDIVIYQY (SEQ ID NO: 2624) | HIV-1 RT330-338 |
| B*35:01 | NPDIVIYQY (SEQ ID NO: 2625) | HIV-1 HIV-1 RT328-336 |
| B*35:01 | VPLDEDFRKY (SEQ ID NO: 2626) | HIV-1 HIV-1 RT273-282 |
| B*40:01 | MEVTPSGTWL (SEQ ID NO: 2627) | SARS-CoV-2 Nucleocapsid protein 322-330 (confirmed epitope) |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Peptide | Source |
|---|---|---|
| B*40:01 | GEARKTFVEL (SEQ ID NO: 2628) | Dengue NS3 528-537 |
| B*40:01 | IEDPPFNSL (SEQ ID NO: 2629) | EBV LMP2 200-208 |
| B*40:01 | REISVPAEIL (SEQ ID NO: 2630) | HCV NS5a 2266-2275 |
| B*40:01 | KEKGGLEGL (SEQ ID NO: 2631) | HIV-1 Nef 92-100 |
| C*06:02 | TRATKMQVI (SEQ ID NO: 2632) | pp65 211-219 |
| C*06:02 | QIKVRVDM (SEQ ID NO: 2633) | 1E1 88-95 |
| C*06:02 | TRRFLPQIL (SEQ ID NO: 2634) | NS3 205-213 |
| C*07:02 | CRVLCCYVL (SEQ ID NO: 2635) | 1E1 309-317 |
| E*01:01 | VMAPRTLIL (SEQ ID NO: 2636) | HLA-C leader sequence peptide |
| E*01:01 | VMAPRTLVL (SEQ ID NO: 2637) | HLA-A leader sequence peptide |
| DRB1*01:01 | DSVTPMILKAQKGGNL (SEQ ID NO: 2641) | Dog dander Can f 1 33-48 |
| DRB1*01:01 | KCIEWEKAQHGA (SEQ ID NO: 2642) | Mugwort pollen Art v 1 25-36 |
| DRB1*01:01 | LPVVLENARILKNCVDAK (SEQ ID NO: 2643) | Cat dander Eel d 1 53-70 |
| DRB1*01:01 | LRQMRTVTPIRMQGG (SEQ ID NO: 2644) | House dust mite Der p1 96-110 |
| DRB1*01:01 | VAAAPQVKYAVFEAALTKAI (SEQ ID NO: 2645) | Timothy grass Phl p 5 p26 |
| DRB1*01:01 | YESYKFIPALEAAVK (SEQ ID NO: 2646) | Grass pollen allergen Phl p 5 196-210 |
| DRB1*01:01 | ETLLRAVESYLLAHS (SEQ ID NO: 2647) | Birch pollen allergen Bet v 1 142-156 |
| DRB1*01:01 | ACYEFLWGPRALVETS (SEQ ID NO: 2648) | MAGE-A3 267-282 |
| DRB1*01:01 | LKEFTVSGNILTIRL (SEQ ID NO: 2649) | NY-ESO-1 123-137 |
| DRB1*01:01 | LLEFYLAMPFATPME (SEQ ID NO: 2650) | NY-ESO-1 87-101 |
| DRB1*01:01 | KVPIKWMALESILRRRF (SEQ ID NO: 2651) | HER2 883-899 |
| DRB1*01:01 | LPLKMLNIPSINVH (SEQ ID NO: 2652) | CMV pp65 116-129 |
| DRB1*01:01 | GAALQIPFAMQMAYRF (SEQ ID NO: 2653) | SARS-CoV Sprotein (873-888) (conserved in SARS-CoV-2) |
| DRB1*01:01 | MAYRFNGIGVTQNVLY (SEQ ID NO: 2654) | SARS-CoV Sprotein (884-899) (conserved in SARS-CoV-2) |
| DRB1*01:01 | QLIRAAEIRASANLAATK (SEQ ID NO: 2655) | SARS-CoV Sprotein (993-1010) (conserved in SARS-CoV-2) |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| Allele | Peptide | Source |
|---|---|---|
| DRB1*01:01 | TVFYNIPPMPL (SEQ ID NO: 2656) | EBV EBNA2 280-290 |
| DRB1*01:01 | TSLYNLRRGTALA (SEQ ID NO: 2657) | EBV EBNA1 515-527 |
| DRB1*01:01 | QAGFFLLTRILTIPQS (SEQ ID NO: 2658) | HBV envelope 179-194 |
| DRB1*01:01 | PPAYRPPNAPILSTL (SEQ ID NO: 2659) | HBV core 158-172 |
| DRB1*01:01 | LCWGELMTLATWVGVN (SEQ ID NO: 2660) | HBV core 60-75 |
| DRB1*01:01 | TLLFNILGGWVAA (SEQ ID NO: 2661) | HCV polyprotein 1806-1818, NS4b |
| DRB1*01:01 | DYVDRFYKTLRAE (SEQ ID NO: 2662) | HIV-1 gag 295-307 |
| DRB1*01:01 | KRWIILGLNKIVRMYSPTSI (SEQ ID NO: 2663) | HIV-1 gag 263-282 |
| DRB1*01:01 | FRDYVDRFYKTLRAEQASQE (SEQ ID NO: 2664) | HIV-1 gag 293-312 |
| DRB1*01:01 | SGPLKAEIAQRLEDV (SEQ ID NO: 2665) | Influenza A MP 17-31 |
| DRB1*01:01 | PKYVKQNTLKLAT (SEQ ID NO: 2666) | Influenza A HA 307-319 |
| DRB1*01:01 | EYLNKIQNSLSTEWSPCSVT (SEQ ID NO: 2667) | CSP 326-345 |
| DRB1*01:01 | PVSKMRMATPLLMQA (SEQ ID NO: 2668) | CLIP 87-101 |
| DRB1*01:01 | QEIYMQHTYPISA (SEQ ID NO: 2669) | TT257-269 |
| DRB1*01:01 | GEEYLILSARDVLAV (SEQ ID NO: 2670) | Mtb 10 kDa chaperonin GroES |
| DRB1*03:01 | HTYTIDWTKDAVTWS (SEQ ID NO: 2671) | *Aspergillus fumigatus* Crf1/p41 171-185 |
| DRB1*03:01 | VYYLTRDPTTPLARAA (SEQ ID NO: 2672) | HCV polyprotein 2800-2815, NS5b |
| DRB1*03:01 | PIVQLQGDSNCLKCFR (SEQ ID NO: 2673) | HPV E2 285-300 |
| DRB1*03:01 | MEAIAKRLDACQDQLLELYE (SEQ ID NO: 2674) | HPV E2 1-20 |
| DRB1*03:01 | RQIFGDYKTTIC (SEQ ID NO: 2675) | PLP 98-109 |
| DRB1*03:01 | PVSKMRMATPLLMQA (SEQ ID NO: 2668) | CLIP 87-101 |
| DRB1*03:01 | MAKTIAYDEEARR (SEQ ID NO: 2676) | Mtb groEL 1-13 |
| DRB1*03:01 | KTIAYDEEARR (SEQ ID NO: 2677) | Mtb groEL 3-13 |
| DRB1*04:01 | APYHFDLSGHAFG (SEQ ID NO: 2678) | Rye grass Lol p1 124-136 |
| DRB1*04:01 | ELEKYQQLNSERGVPN (SEQ ID NO: 2679) | Cow dander Bos d 2 143-158 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

```
DRB1*04: 01  ETLLRAVESYLLAHS          Birch pollen allergen Bet v 1 141-155
             (SEQ ID NO: 2680)

DRB1*04: 01  VAAAPQVKYAVFEAALTK       Timothy grass Phl p 5 p26
             AI
             (SEQ ID NO: 2645)

DRB1*04: 01  FHTYTIDWTKDAVTW          Aspergillus fumigatus Crf1/p41 170-184
             (SEQ ID NO: 2681)

DRB1*04: 01  NFIRMVISNPAAT            GAD65 555-567
             (SEQ ID NO: 2682)

DRB1*04: 01  IAFTSEHSHFSLK            GAD65 274-286
             (SEQ ID NO: 2683)

DRB1*04: 01  GAGSLQPLALEGSLQKRG       Proinsulin 73-90
             (SEQ ID NO: 2684)

DRB1*04: 01  GIVEQCCTSICSLYQ          Proinsulin 90-104
             (SEQ ID NO: 2685)

DRB1*04: 01  ATEG[cit]V[cit]VNS       Cit aggregan 89-103
             AYQDK
             (SEQ ID NO: 2686)

DRB1*04: 01  ATIKAEFV[cit]AETPYM      Cit CILP 297-311
             (SEQ ID NO: 2687)

DRB1*04: 01  DVMNILLQYVVKSFDRSTKV     GAD65 113-132
             (SEQ ID NO: 2030)

DRB1*04: 01  GKLYGI[cit]              Cit CILP 982-996
             (SEQ ID NO: 2688)

DRB1*04: 01  GVYAT[cit]SSAV[cit]L     Cit vimentin aa 59-78
             [cit]SSVPGVR
             (SEQ ID NO: 2689)

DRB1*04: 01  IFDS[cit]GNPTVEVDLF      Cit alpha-enolase 11-25
             (SEQ ID NO: 2690)

DRB1*04: 01  KGMAALPRLIAFTSEHSHFS     GAD65 265-284
             (SEQ ID NO: 2691)

DRB1*04: 01  QDFTN[cit]INKLKNS        Cit fibrinogen-alpha 79-91
             (SEQ ID NO: 2692)

DRB1*04: 01  WNRQLYPEWTEAQRLD         gp100 44-59
             (SEQ ID NO: 2693)

DRB1*04: 01  ISPNSVFSQWRVVCDSLEDY     Tyrp1 277-297
             D
             (SEQ ID NO: 2694)

DRB1*04: 01  ESEFQAALSRKVAKL          MAGE-A6 102-116
             (SEQ ID NO: 2695)

DRB1*04: 01  LTQYFVQENYLEYRQVPG       MAGE-A6 246-263
             (SEQ ID NO: 2696)

DRB1*04: 01  YACFVSNLATGRNNS          CEA 653-667
             (SEQ ID NO: 2697)

DRB1*04: 01  NYTLRVDCTPLMYSL          PSMA 459-473
             (SEQ ID NO: 2698)

DRB1*04: 01  IYRRRLMKQDFSVPQLPHS      gp100 615-633
             (SEQ ID NO: 2699)

DRB1*04: 01  ALHIYMDGTMSQVQGSA        tyrosinase 365-381
             (SEQ ID NO: 2700)
```

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| DRB1*04: 01 | RNGYRALMDKSLHVGTQCALTRR (SEQ ID NO: 2701) | MART-1 51-73 |
| DRB1*04: 01 | LKEFTVSGNILTIRL (SEQ ID NO: 2649) | NY-ESO-1 123-137 |
| DRB1*04: 01 | LLEFYLAMPFATPME (SEQ ID NO: 2650) | NY-ESO-1 87-101 |
| DRB1*04: 01 | KVPIKWMALESILRRRF (SEQ ID NO: 2651) | HER2 883-899 |
| DRB1*04: 01 | QALNTLVKQLSSNFGAI (SEQ ID NO: 2702) | SARS-CoV Sprotein (939-955) (conserved in SARS-CoV-2) |
| DRB1*04: 01 | QLIRAAEIRASANLAATK (SEQ ID NO: 2655) | SARS-CoV Sprotein (993-1010) (conserved in SARS-CoV-2) |
| DRB1*04: 01 | PYYVVDLSVRGM (SEQ ID NO: 2703) | EBV BHRF1 122-133 |
| DRB1*04: 01 | AEGLRALLARSHVER (SEQ ID NO: 2704) | EBV EBNA1 482-496 |
| DRB1*04: 01 | GQTYHLIVDTDSLGNPSLSV (SEQ ID NO: 2705) | EBV EBNA2 11-30 |
| DRB1*04: 01 | LSFLPSDFFPSVRDL (SEQ ID NO: 2706) | HBV core 45-59 |
| DRB1*04: 01 | GYKVLVLNPSVAATL (SEQ ID NO: 2707) | HCV polyprotein 1248-1262, NS3 |
| DRB1*04: 01 | SGIQYLAGLSTLPGNPAIASL (SEQ ID NO: 2708) | HCV polyprotein 1770-1790, NS4b |
| DRB1*04: 01 | AFSPEVIPMFSALSEGATPQ (SEQ ID NO: 2709) | HIV-1 gag 163-182 |
| DRB1*04: 01 | FWRGENGRKTRIAYERMCNILKGK (SEQ ID NO: 2710) | Influenza A NP 206-229 |
| DRB1*04: 01 | GFVFTLTVPSER (SEQ ID NO: 2711) | Influenza A MP 61-72 |
| DRB1*04: 01 | PKYVKQNTLKLAT (SEQ ID NO: 2666) | Influenza A HA 307-319 |
| DRB1*04: 01 | EYLNKIQNSLSTEWSPCSVT (SEQ ID NO: 2667) | CSP 326-345 |
| DRB1*04: 01 | RTELLKDAIGEGK (SEQ ID NO: 2712) | MOG 97-109 |
| DRB1*04: 01 | TWTTCQSIAFPSKTSASIGS (SEQ ID NO: 2713) | PLP 180-199 |
| DRB1*04: 01 | PVSKMRMATPLLMQA (SEQ ID NO: 2668) | CLIP 87-101 |
| DRB1*04: 01 | SSPKPWIYATSNLAS (SEQ ID NO: 2714) | Rituximab Light chain 41-55 |
| DRB1*04: 02 | PKYVKQNTLKLAT (SEQ ID NO: 2666) | Influenza A HA 307-319 |
| DRB1*04: 02 | PVSKMRMATPLLMQA (SEQ ID NO: 2668) | CLIP 87-101 321-3339 |
| DRB1*04: 05 | LWWVNNQSLPVSP (SEQ ID NO: 2715) | CEA 331-3339 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| DRB1*04:05 | PKYVKQNTLKLAT (SEQ ID NO: 2666) | Influenza A HA 307-319 |
| DRB1*04:05 | PVSKMRMATPLLMQA (SEQ ID NO: 2668) | CLIP 87-101 |
| DRB1*07:01 | DRVNFKYSFSVIE (SEQ ID NO: 2716) | Alder pollen Aln g 1 76-88 |
| DRB1*07:01 | VAAAPQVKYAVFEAALTKAI (SEQ ID NO: 2645) | Timothy grass Phl p 5 p26 |
| DRB1*07:01 | VGLLKAVESYLLA (SEQ ID NO: 2717) | Alder pollen Aln g 1 142-154 |
| DRB1*07:01 | YYSNVTATRLLSSTNS (SEQ ID NO: 2718) | Pertussis toxin subunit 2 129-144 |
| DRB1*07:01 | EPDVYYTSAFVFPTK (SEQ ID NO: 2719) | CMV pp65 177-191 |
| DRB1*07:01 | PDDYSNTHSTRYVTV (SEQ ID NO: 2720) | CMV gB 215-229 |
| DRB1*07:01 | VPGLYSPCRAFFNKEELL (SEQ ID NO: 2721) | EBV MCP 1264-1281 |
| DRB1*07:01 | PGPLRESIVCYFMVFLQTHI (SEQ ID NO: 2722) | EBV EBNA1 551-570 |
| DRB1*07:01 | VYGGSKTSLYNLRRGTALAI (SEQ ID NO: 2723) | EBV EBNA1 509-528 |
| DRB1*07:01 | PRSPTVFYNIPPMPLPPSQL (SEQ ID NO: 2724) | EBV EBNA2 276-295 |
| DRB1*07:01 | AYCLWMMLLISQAEAALELI T (SEQ ID NO: 2725) | HCV N52 732-753 |
| DRB1*07:01 | WPLLLLLLALPQRAYAQ (SEQ ID NO: 2726) | HCV N52 47-63 |
| DRB1*07:01 | SLTITSLLRRHNWITSCS (SEQ ID NO: 2727) | HCV NS5a 1957-1975 |
| DRB1*07:01 | TTVRLRAYMNTPGLPVC (SEQ ID NO: 2728) | HCV NS3 1535-1551 |
| DRB1*07:01 | FRDYVDRFYKTLRAEQASQE (SEQ ID NO: 2664) | HIV-1 gag 293-312 |
| DRB1*07:01 | PKYVKQNTLKLAT (SEQ ID NO: 2666) | Influenza A HA 307-319 |
| DRB1*07:01 | EYLNKIQNSLSTEWSPCSVT (SEQ ID NO: 2667) | CSP 326-345 |
| DRB1*07:01 | PVSKMRMATPLLMQA (SEQ ID NO: 2668) | CLIP 87-101 |
| DRB1*07:01 | WVKQTPGRGLEWIGA (SEQ ID NO: 2729) | Rituximab Heavy chain 36-50 |
| DRB1*07:01 | SSPKPWIYATSNLAS (SEQ ID NO: 2714) | Rituximab Light chain 41-55 |
| DRB1*07:01 | EWVAEIRSKSINSAT (SEQ ID NO: 2730) | Infliximab Heavy chain 46-60 |
| DRB1*09:01 | VAAAPQVKYAVFEAALTKAI (SEQ ID NO: 2645) | Timothy grass Phl p 5 p26 |
| DRB1*09:01 | LLEFYLAMPFATPME (SEQ ID NO: 2650) | NY-ESO-1 87-101 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| DRB1*09: 01 | PVSKMRMATPLLMQA (SEQ ID NO: 2668) | CLIP 87-101 |
| DRB1*09: 01 | MTEQQWNFAGIEAAA (SEQ ID NO: 2731) | Mtb ESAT6 1-15 |
| DRB1*11: 01 | LEAAFNAEFNEIRRVLLEEN (SEQ ID NO: 2732) | Peanut Ara h 1 321-340 |
| DRB1*11: 01 | TSRNNPFYFPSRRFSTRYGN (SEQ ID NO: 2733) | Peanut Ara h 1 169-188 |
| DRB1*11: 01 | VVNKGTGNLELVAVRKEQQQ (SEQ ID NO: 2734) | Peanut Ara h 1 457-476 |
| DRB1*11: 01 | VAAAPQVKYAVFEAALTKAI (SEQ ID NO: 2645) | Timothy grass Phl p 5 p26 |
| DRB1*11: 01 | TSYVKVLHHMVKISG (SEQ ID NO: 2735) | MAGE-A3 281-295 |
| DRB1*11: 01 | ENIQRFLPNPAGVQLEDPEF (SEQ ID NO: 2736) | Factor VIII589-608 |
| DRB1*11: 01 | FRDYVDRFYKTLRAEQASQE (SEQ ID NO: 2664) | HIV-1 gag 293-312 |
| DRB1*11: 01 | PKYVKQNTLKLAT (SEQ ID NO: 2666) | Influenza A HA 307-319 |
| DRB1*11: 01 | PVSKMRMATPLLMQA (SEQ ID NO: 2668) | CLIP 87-101 |
| DRB1*11: 01 | VSIDKFRIFCKALNPK (SEQ ID NO: 2737) | TT 1084-1099 |
| DRB1*11: 01 | FNNFTVSFWLRVPKVSASHLE (SEQ ID NO: 2738) | TT 947-967 |
| DRB1*11: 01 | KFIIKRYTPNNEIDSF (SEQ ID NO: 2739) | TT 1174-1189 |
| DRB1*11: 01 | QYIKANSKFIGITEL (SEQ ID NO: 2740) | TT 830-844 |
| DRB1*11: 01 | WVKQTPGRGLEWIGA (SEQ ID NO: 2729) | Rituximab Heavy chain 36-50 |
| DRB1*15: 01 | VAAAPQVKYAVFEAALTKAI (SEQ ID NO: 2645) | Timothy grass Phl p 5 p26 |
| DRB1*15: 01 | VGLLKAVESYLLA (SEQ ID NO: 2717) | Alder pollen Aln g 1 142-154 |
| DRB1*15: 01 | AVNIVGYSNAQGVDY (SEQ ID NO: 2741) | House dust mite Der p1 251-265 |
| DRB1*15: 01 | ETLLRAVESYLLAHS (SEQ ID NO: 2647) | Birch pollen allergen Bet v 1 142-156 |
| DRB1*15: 01 | LRQMRTVTPIRMQGG (SEQ ID NO: 2644) | House dust mite Der p1 96-110 |
| DRB1*15: 01 | DENPVVHFFKNIVTPRTPP (SEQ ID NO: 2027) | Myelin basic protein 83-101 |
| DRB1*15: 01 | MSIYVYALPLKMLNI (SEQ ID NO: 2742) | CMV pp65 109-123 |
| DRB1*15: 01 | NFPYLVAYQATVCARA (SEQ ID NO: 2743) | HCV polyprotein 1582-1597, NS3 |

TABLE 5-continued

Each line of the following Table provides a MHC allele (whose sequence is available in publically-accessible databases, e.g., (NCBI), and an antigen sequence. The antigen source and/or the relevant disease are also indicated on some lines. In some examples provided in Table 5, the peptides are antigen mimics and their origin is indicated.

| | | |
|---|---|---|
| DRB1*15:01 | GINAVAYYRGLDVSV (SEQ ID NO: 2744) | HCV polyprotein 1411-1425, NS3 |
| DRB1*15:01 | TTVRLRAYMNTPGLPVC (SEQ ID NO: 2728) | HCV NS3 1535-1551 |
| DRB1*15:01 | PVSKMRMATPLLMQA (SEQ ID NO: 2668) | CLIP 87-101 |
| DRB1*15:01 | SSPKPWIYATSNLAS (SEQ ID NO: 2714) | Rituximab Light chain 41-55 |
| DRB1*15:01 | EWVAEIRSKSINSAT (SEQ ID NO: 2730) | Infliximab Heavy chain 46-60 |
| DRB1*15:01 | MHVSFVMAYPEMLAA (SEQ ID NO: 2745) | Mtb PEfamily protein |
| DRB1*15:01 | MSQIMYNYPAMMAHA (SEQ ID NO: 2746) | Mtb ESAT-6 like protein |

As further illustrative and non-limiting examples, the following antigens provided in Table 6 are known in the art to be relevant to celiac disease. In some embodiments, the TCR recognition domain can comprise one or more of the peptides provided in Table 6. In some embodiments, the TCR recognition domain can comprise a sequence with at least 80%, at least 85%, at least 90%, at least 95%, at least 98% or greater sequence identity to one of the peptides of Table 6. In some embodiments, the TCR recognition domain can comprise a sequences with at least 95% sequence identity to one of peptides of Table 6, wherein that sequence retains the wild-type activity of the peptide of Table 6.

TABLE 6

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 1 | alpha-gliadin | alpha-gliadin CT-1 (p1-p22 of B 3142) | Toxic | Native | Unknown | 41 | 22 | VPVPQLQPQNPSQQQPQEQVPL |
| 2 | alpha-gliadin | alpha-gliadin peptide CT-2 (p23-p53 of B 3142) | Toxic | Native | Unknown | 41 | 31 | VQQQQFPQQQQFPPQQPYPQPQPFPSQQPY |
| 3 | alpha-gliadin | alpha-gliadin p14 (p1-p19) | Immunogenic | Native | DQ2 | 34 | 19 | VRVPVPQLQPQNPSQQQPQ |
| 4 | alpha-gliadin | alpha-gliadin p15 (p11-p28) | Immunogenic | Native | DQ2 | 34 | 18 | QNPSQQQPQEQVPLVQQ |
| 5 | alpha-gliadin | alpha-gliadin p209 | Immunogenic | Native | DQ2 | 39, 34 | 20 | FPGQQQPFPPQQPYPQPQPF |
| 7 | alpha-gliadin | alpha-gliadin (p44-p55) | Immunogenic, Toxic | Native | HLA-DR | 10 | 12 | PQQPFPSQQPY |
| 8 | alpha-gliadin | Epitope DQ2-alpha-I/II/III | Immunogenic | Native | DQ2 | 62 | 20 | YLQLQPFPQPQLPYPQPQLP |
| 9 | alpha-gliadin | alpha2-gliadin 1420 (p56-p70) | Immunogenic | Native | DQ2, DQ8 | 17 | 15 | YLQLQPFPQPQLPYP |
| 10 | alpha-gliadin | alpha2-gliadin 33-mer (p57-p89) | Immunogenic | Native | DQ2, DQ8 (DQ2/8) | 2, 25 | 33 | LQLQPFPQPQLPYPQPQLPYPQPQLPYPQPQPF |
| 11 | alpha-gliadin | Deamidated alpha2-gliadin 33-mer (p57-p89) | Immunogenic | Deamidated | DQ2.5 | 61 | 33 | LQLQPFPQPELPYPQPELPYPQPELPYPQPQPF |
| 12 | alpha-gliadin | alpha-2 gliadin G8 (p56-p75) | Toxic, Immunogenic | Native | DQ2 | 51, 63 | 20 | LQLQPFPQPQLPYPQPQLPY |
| 13 | alpha-gliadin | alpha-2 gliadin G9 (p56-p75; E65) | Immunogenic | Deamidated | DQ2 | 51 | 20 | LQLQPFPQPELPYPQPQLPY |
| 14 | alpha-gliadin | alpha-9 gliadin G5 (p56-p68) | Immunogenic | Native | DQ2 | 51 | 13 | LQLQPFPQPQLPY |
| 15 | alpha-gliadin | alpha-9 gliadin G5 (p56-p68; E65) | Immunogenic | Deamidated | DQ2 | 51 | 13 | LQLQPFPQPELPY |
| 16 | alpha-gliadin | Wheat peptide W02 | Immunogenic | Native | DQ2 | 62, 86 | 16 | QLQPFPQPQLPYPQPQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 17 | alpha-gliadin | Glia-alpha9 (p57-p71) | Immunogenic | Native | DQ2 | 9 | 15 | QLQPFPQPQLPYPQP |
| 18 | alpha-gliadin | Glia-alpha9 (p57-p71; T69 and H70) | Immunogenic | Native | DQ2 | 9 | 15 | QLQPFPQPQLPYTHP |
| 19 | alpha-gliadin | Glia-alpha9 (p57-p71; R59) | Immunogenic | Native | DQ2 | 9 | 15 | QLRPFPQPQLPYPQP |
| 20 | alpha-gliadin | Glia-alpha9 (p57-p71; H63 and H70) | Immunogenic | Native | DQ2 | 9 | 15 | QLQPFPHPQLPYPHP |
| 21 | alpha-gliadin | Glia-alpha9 (p57-p71; A63) | Immunogenic | Native | DQ2 | 9 | 15 | QLQPFPQAQLPYPQP |
| 22 | alpha-gliadin | Glia-alpha9 (p57-p70) | Immunogenic | Native | DQ2 | 8 | 14 | QLQPFPQPQLPYPQ |
| 23 | alpha-gliadin | Glia-alpha9 (p57-p70; E65) | Immunogenic | Deamidated | DQ2 | 8 | 14 | QLQPFPQPELPYPQ |
| 24 | alpha-gliadin | alpha-9 gliadin (p57-p68); alpha2/alpha9 gliadin | Immunogenic | Native | DQ2 | 14, 23, 2, 84 | 12 | QLQPFPQPQLPY |
| 25 | alpha-gliadin | alpha-9 gliadin (p57-p68; E65); alpha-I | Immunogenic | Deamidated | DQ2 | 43, 14, 8, 84 | 12 | QLQPFPQPELPY |
| 26 | alpha-gliadin | alpha-9 gliadin epitope homolog (p57-p68; E63 (considered native form of synthetic)) | Immunogenic | Native | DQ2 | 8 | 12 | QLQPFPEPQLPY |
| 27 | alpha-gliadin | alpha-9 gliadin epitope homolog (p57-p68; E63 and E65 (tTG-treated form)) | Immunogenic | Deamidated | DQ2 | 8 | 12 | QLQPFPEPELPY |
| 28 | alpha-gliadin | alpha-9 gliadin epitope homolog (p57-p68; Q64 (considered native form of synthetic)) | Immunogenic | Native | DQ2 | 8 | 12 | QLQPFPQQQLPY |
| 29 | alpha-gliadin | alpha-9 gliadin epitope homolog (p57-p68; Q64 and E63 (tTG-treated form)) | Immunogenic | Deamidated | DQ2 | 8 | 12 | QLQPFPEQQLPY |
| 30 | alpha-gliadin | alpha-9 gliadin epitope homolog (p57-p68; Q64 and E65 (tTG-treated form)) | Immunogenic | Deamidated | DQ2 | 8 | 12 | QLQPFPQQELPY |
| 31 | alpha-gliadin | alpha-9 gliadin epitope homolog (p57-p68; Q64, E63 and E65 (tTG-treated form)) | Immunogenic | Deamidated | DQ2 | 8 | 12 | QLQPFPEQELPY |
| 32 | alpha-gliadin | DQ2-Glia-alpha1 epitope (p58-p72) | Immunogenic | Native | DQ2 | 59 | 15 | LQPFPQPQLPYPQPQ |
| 33 | alpha-gliadin | DQ2-Glia-alpha1 epitope (p58-p72; E65) | Immunogenic | Deamidated | DQ2 | 59 | 15 | LQPFPQPELPYPQPQ |
| 34 | alpha-gliadin | DQ2-Glia-alpha1 epitope (p58-p72; S64) | Immunogenic | Native | DQ2 | 59 | 15 | LQPFPQSQLPYPQPQ |

TABLE 6-continued

The sequences are, in the order presented, SEQ ID NOs: 1000-2012.

| ID | Type | Description | Toxicity Form | HLADQ | Refs | SeqLen | Sequence |
|---|---|---|---|---|---|---|---|
| 35 | alpha-gliadin | DQ2-Glia-alpha1 epitope (p58-p72; S64 and E65) | Immunogenic Deamidated | DQ2 | 59 | 15 | LQPFPQSELPYPQPQ |
| 36 | alpha-gliadin | DQ2-alpha-I epitope (p58-p68) | Immunogenic Native | DQ2 | 47 | 11 | LQPFPQPQLPY |
| 37 | alpha-gliadin | DQ2-alpha-I epitope (p58-p68; E65 considered Deamidated form) | Immunogenic Deamidated | DQ2 | 47 | 11 | LQPFPQPELPY |
| 38 | alpha-gliadin | Glia-alpha2 (p60-p76) | Immunogenic Native | DQ2 | 8 | 17 | QPFPQPQLPYPQPQLPY |
| 39 | alpha-gliadin | Glia-alpha2 (p60-p76; E66) | Immunogenic Deamidated | DQ2 | 8 | 17 | QPFPQPELPYPQPQLPY |
| 40 | alpha-gliadin | Glia-alpha2 (p60-p76; E73) | Immunogenic Deamidated | DQ2 | 8 | 17 | QPFPQPQLPYPQPELPY |
| 41 | alpha-gliadin | Glia-alpha2 (p60-p76; E66 and E73) | Immunogenic Deamidated | DQ2 | 8 | 17 | QPFPQPELPYPQPELPY |
| 42 | alpha-gliadin | Glia-alpha2 (p60-p69) | Immunogenic Native | DQ2 | 45 | 10 | QPFPQPQLPY |
| 43 | alpha-gliadin | Glia-alpha2 (p60-p69; E66) | Immunogenic Deamidated | DQ2 | 45 | 10 | QPFPQPELPY |
| 44 | alpha-gliadin | alpha2-gliadin 1421 (p61-p75) | Immunogenic Native | DQ2, DQ8 | 17 | 15 | PFPQPQLPYPQPQLP |
| 45 | alpha-gliadin | Glia-alpha2 (p61-p71) | Immunogenic Native | DQ2 | 59 | 11 | PFPQPQLPYPQ |
| 46 | alpha-gliadin | Glia-alpha2 (p61-p71; E66) | Immunogenic Deamidated | DQ2 | 59 | 11 | PFPQPELPYPQ |
| 47 | alpha-gliadin | Glia-alpha2 (p61-p71; T70 and H71) | Immunogenic Native | DQ2 | 59 | 11 | PFPQPQLPYTH |
| 48 | alpha-gliadin | Glia-alpha2 (p61-p71; T70, H71 and E66) | Immunogenic Deamidated | DQ2 | 59 | 11 | PFPQPELPYTH |
| 49 | alpha-gliadin | Glia-alpha2 (p61-p71; H64) | Immunogenic Native | DQ2 | 59 | 11 | PFPHPQLPYPQ |
| 50 | alpha-gliadin | Glia-alpha2 (p61-p71; H64 and E66) | Immunogenic Deamidated | DQ2 | 59 | 11 | PFPHPELPYPQ |
| 53 | alpha-9 gliadinDQ2.5_glia_alpha-1a | | Immunogenic Native | DQ2.5 | 14, 90, 17, 23 | 9 | PFPQPQLPY |
| 54 | alpha-9 gliadinDQ2.5_glia_alpha-1a | | Immunogenic Deamidated | DQ2.5 | 14, 90, 17, 23 | 9 | PFPQPELPY |
| 55 | alpha-2 gliadin alpha-2 gliadin 1206 (p62-p75) | | Immunogenic Native | DQ2 | 14, 1, 2 | 14 | PQPQLPYPQPQLPY |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 56 | alpha-gliadin | alpha-II/alpha-III epitope (p62-p75; E72) | Immunogenic | Deamidated | DQ2 | 14 | 14 | PQPQLPYPQPELPY |
| 57 | alpha-gliadin | alpha-2 gliadin (p62-p75; E65) | Immunogenic | Deamidated | DQ2 | 14, 25 | 14 | PQPELPYPQPQLPY |
| 58 | alpha-gliadin | alpha-2 gliadin (p62-p75; E65 and E72) | Immunogenic | Deamidated | DQ2 | 14 | 14 | PQPELPYPQPELPY |
| 59 | alpha-gliadin | G4-9A gliadin (p62-p75; E65 and A70) | Immunogenic | Deamidated | DQ2 | 51 | 14 | PQPELPYPAPQLPY |
| 60 | alpha-gliadin | G4-11A gliadin (p62-p75; E65 and A72) | Immunogenic | Deamidated | DQ2 | 51 | 14 | PQPELPYPQPALPY |
| 61 | alpha-gliadin | gliadin (p62-p75; E65 and A73) | Immunogenic | Deamidated | DQ2 | 51 | 14 | PQPELPYPQPQAPY |
| 62 | alpha-gliadin | gliadin (p62-p75; E65 and A74) | Immunogenic | Deamidated | DQ2 | 51 | 14 | PQPELPYPQPQLAY |
| 63 | alpha-gliadin | gliadin (p62-p75; E65 and A70) | Immunogenic | Deamidated | DQ2 | 51 | 14 | PQPELPYPQPQLPA |
| 64 | alpha-gliadin | alpha-2 gliadin (p62-p73) | Immunogenic | Native | DQ2 | 25, 47 | 12 | PQPQLPYPQPQL |
| 65 | alpha-gliadin | alpha-2 gliadin (p62-p73; E65) | Immunogenic | Deamidated | DQ2 | 25, 47 | 12 | PQPELPYPQPQL |
| 66 | alpha-gliadin | alpha-11 (p62-p72) | Immunogenic | Native | DQ2 | 43 | 11 | PQPQLPYPQPQ |
| 67 | alpha-gliadin | alpha-11 (p62-p72; E65 and E72) | Immunogenic | Deamidated | DQ2 | 43 | 11 | PQPELPYPQPE |
| 68 | alpha-2 gliadinCAUTION 100% match to one fungal protein and many wheat proteins with multiple epitopes DQ2.5_glia_alpha2 | | Immunogenic | Native | DQ2.5 | 14, 17, 23 | 9 | PQPQLPYPQ |
| 69 | alpha-2 gliadinDQ2.5_glia alpha2 | | Immunogenic | Deamidated | DQ2.5 | 14, 17, 23 | 9 | PQPELPYPQ |
| 70 | alpha-gliadin | alpha2-gliadin 1423 (p71-p85) | Immunogenic | Native | DQ2, DQ8 | 17 | 15 | QPQLPYPQPQLPYPQ |
| 71 | alpha-gliadin | a-gliadin (p62-p84) | Immunogenic | Native | DQ2 | 62 | 20 | PQLPYPQPQLPYPQPQLPYP |
| 72 | alpha-gliadin | alpha-III-gliadin (p62-p79) | Immunogenic | Native | DQ2 | 25 | 12 | PQLPYPQPQLPY |
| 73 | alpha-gliadin | alpha-III-gliadin (p62-p79; E76) | Immunogenic | Deamidated | DQ2 | 25 | 12 | PQLPYPQPELPY |
| 74 | alpha-gliadin | alpha-I epitope | Immunogenic | Native | DQ2 | 25 | 12 | LQLPFPQPQLPY |
| 75 | alpha-gliadin | alpha-I epitope Deamidated form | Immunogenic | Deamidated | DQ2 | 25 | 12 | LQLPFPQPELPY |
| 76 | alpha-gliadin | Glia-alpha2 25-mer (p64-p89) | Immunogenic | Deamidated | DQ2 | 57 | 25 | PQLPQFLQPQPYPQPQLPYPQPQPF |
| 77 | alpha-gliadin | Glia-alpha2 25-mer (p64-p89; E65) | Immunogenic | Deamidated | DQ2 | 57 | 25 | PELPQFLQPQPYPQPQLPYPQPQPF |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 78 | alpha-gliadin | Glia-alpha2 25-mer (p64-p89; E79) | Immunogenic | Deamidated | DQ2 | 57 | 25 | PQLPQFLQPQPYPQ PELPYPQPQPF |
| 79 | alpha-gliadin | Glia-alpha2 25-mer (p64-p89; E65 and E79) | Immunogenic | Deamidated | DQ2 | 57 | 25 | PELPQFLQPQPYPQ PELPYPQPQPF |
| 80 | alpha-gliadin | alpha2-gliadin 1422 (p66-p80) | Immunogenic | Native | DQ2 | 17 | 15 | QLPYPQPQLPYPQ Q |
| 81 | alpha-gliadin | alpha-III epitope (p66-p78) | Immunogenic | Native | DQ2 | 47 | 13 | QLPYPQPQLPYPQ |
| 82 | alpha-gliadin | alpha-III epitope (p66-p78; E72) | Immunogenic | Deamidated | DQ2 | 47 | 13 | QLPYPQPELPYPQ |
| 83 | alpha-gliadin | Wheat peptide W01 | Immunogenic | Native | DQ2 | 62 | 12 | LPYPQPQLPYPQ |
| 84 | alpha-3 gliadin | DQ2.5_glia_alpha 1b | Immunogenic | Native | DQ2.5 | 23 | 9 | PYPQPQLPY |
| 85 | alpha-3 gliadin | DQ2.5_glia_alpha 1b | Immunogenic | Deamidated | DQ2.5 | 23 | 9 | PYPQPELPY |
| 86 | alpha-gliadin | Glia-alpha2 18-mer (p71-p89) | Immunogenic | Native | DQ2 | 82 | 18 | QPQPYPQPQLPYPQ PQPF |
| 87 | alpha-gliadin | Glia-alpha2 18-mer (p71-p89; E79) | Immunogenic | Deamidated | DQ2 | 82, 57 | 18 | QPQPYPQPELPYPQ PQPF |
| 88 | alpha-gliadin | Wheat peptide W18 | Immunogenic | Native | DQ2 | 62, 82 | 20 | PQLPYPQPQLPYPQ PQPFRP |
| 89 | alpha-gliadin | Wheat peptide W18 | Immunogenic | Deamidated | DQ2 | 62 | 20 | PQLPYPQPELPYPQ PQPFRP |
| 90 | alpha-gliadin | Wheat peptide W18 | Immunogenic | Native | DQ2 | 62 | 16 | YPQPQLPYPQPQPF RP |
| 91 | alpha-gliadin | Wheat peptide W18 | Immunogenic | Deamidated | DQ2 | 62 | 16 | YPQPELPYPQPQPF RP |
| 92 | alpha-gliadin | alpha2-gliadin 1424 (p76-p90) | Immunogenic | Native | DQ2 | 17 | 15 | YPQPQLPYPQPQPF R |
| 93 | alpha-20 gliadin | DQ2.5_glia_alpha 3 | Immunogenic | Native | DQ2.5 | 90, 8 | 9 | FRPQQPYPQ |
| 94 | alpha-20 gliadin | DQ2.5_glia_alpha 3 | Immunogenic | Deamidated | DQ2.5 | 90, 8 | 9 | FRPEQPYPQ |
| 95 | alpha-gliadin | Gliadin (p198-p222) | Immunogenic | Native | DQ8 (DQ2/8, DQ1/8) | 3 | 25 | QQPQQQYPSGQGSF QPSQQNPQAQG |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 96 | alpha-gliadin | alpha-2 gliadin (p219-p242) AJ133612 | Immunogenic | Native | DQ8 | 6 | 24 | QQPQQQYPSGQGSFQPSQQNPQAQ |
| 97 | alpha-gliadin | alpha-2 gliadin (p219-p242; E229 and E237) AJ133612 | Immunogenic | Deamidated | DQ8 | 6 | 24 | QQPQQQYPSGEGSFQPSEENPQAQ |
| 98 | alpha-gliadin | alpha-2 gliadin (p219-p242; E229) AJ133612 | Immunogenic | Deamidated | DQ8 | 6 | 24 | QQPQQQYPSGEGSFQPSQQNPQAQ |
| 99 | alpha-gliadin | alpha-2 gliadin (p219-p242; E237) AJ133612 | Immunogenic | Deamidated | DQ8 | 6 | 24 | QQPQQQYPSGQGSFQPSQENPQAQ |
| 100 | alpha-gliadin | alpha-gliadin (p220-p239) P18573 | Immunogenic | Native | DQ8 | 54 | 20 | QPQQQYPSGQGSFQPSQNP |
| 101 | alpha-gliadin | Gda09 (p202-p219) P18573 | Immunogenic | Native | DQ8 (DQ2/8, DQ1/8) | 3, 4 | 18 | QQYPSGQGSFQPSQQNPQ |
| 102 | alpha-gliadin | Gda09 (p203-p220) P18573 (alpha-gliadin (alpha-I)) | Immunogenic | Native | DQ8 | 5 | 18 | QYPSGQGSFQPSQQNPQA |
| 103 | alpha-gliadin | Gda09 (p203-p220; E216) P18573 (alpha-gliadin (alpha-l)) | Immunogenic | Deamidated | DQ8 | 5 | 18 | QYPSGEGSFQPSQENPQA |
| 104 | alpha-gliadin | alpha2-gliadin 1447 (p226-p240) | Immunogenic | Native | DQ8 | 17 | 15 | YPSGQGSFQPSQQNP |
| 105 | alpha-gliadin | Gliadin (p205-p222) | Immunogenic | Native | DQ8 | 3 | 18 | PSGQGSFQPSQQNPQAQG |
| 106 | alpha-gliadin | Gliadin (p205-p216); alpha2-gliadin | Immunogenic | Native | DQ8 | 46, 3 | 12 | PSGQGSFQPSQQ |
| 107 | alpha-gliadin | Gliadin (p205-p215); alpha2-gliadin | Immunogenic | Native | DQ8 | 46, 3 | 11 | PSGQGSFQPSQ |
| 108 | alpha-gliadin | Gda09 (p206-p217) P18573 | Immunogenic | Native | DQ8 | 46, 4 | 12 | SGQGSFQPSQQN |
| 109 | alpha-gliadin | Gda09 (p206-p217; E215) P18573 | Immunogenic | Deamidated | DQ8 | 46 | 12 | SGQGSFQPSEQN |
| 110 | alpha-gliadin | Gda09 (p206-p217; E208) P18573 | Immunogenic | Deamidated | DQ8 | 46, 83, 4 | 12 | SGEGSFQPSQQN |
| 111 | alpha-gliadin | Gda09 (p206-p217; E216) P18573 | Immunogenic | Deamidated | DQ8 | 46, 4 | 12 | SGQGSFQPSQEN |
| 112 | alpha-gliadin | Gda09 (p206-p217; E208 and E216) P18573 | Immunogenic | Deamidated | DQ8 | 3, 4 | 12 | SGEGSFQPSQEN |
| 113 | alpha-gliadin | alpha2-gliadin (p228-p236) | Immunogenic | Native | DQ8 | 6 | 9 | GQGSFQPSQ |
| 115 | alpha-2 gliadin | alpha-2 gliadinCAUTION 100% identity match to Dicot plant protein DQ8.5_glia_alpha 1 and many wheat family DQ8_glia_alpha 1 | Immunogenic | Native | DQ8 (DQ2/8) | 6, 90, 3 | 9 | QGSFQPSQQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 116 | alpha-2 gliadin | alpha-2 gliadinDQ8_glia_alpha 1 DQ8.5_glia_alpha 1 | Immunogenic | Deamidated | DQ8 (DQ2/8) | 90, 17, 83 | 9 | EGSFQPSQQ |
| 117 | alpha-2 gliadin | alpha-2 gliadinDQ8_glia_alpha 1 DQ8.5_glia_alpha 1 | Immunogenic | Deamidated | DQ8 (DQ2/8) | 90, 17 | 9 | QGSFQPSQE |
| 118 | alpha-2 gliadin | alpha-2 gliadinDQ8_glia_alpha 1 DQ8.5_glia_alpha 1 | Immunogenic | Deamidated | DQ8 (DQ2/8) | 90, 17 | 9 | EGSFQPSQE |
| 119 | alpha-gliadin | alpha2-gliadin 1448 (p231-p245) | Immunogenic | Native | DQ8 | 17 | 15 | GSFQPSQQNPQAQGS |
| 120 | alpha-gliadin | alpha2-gliadin 1450 (p241-p255) | Immunogenic | Native | DQ8 and weak DQ2 | 17 | 15 | QAQGSVQPQQLPQFE |
| 121 | alpha-gliadin | Wheat peptide W02 | Immunogenic | Native | DQ2 | 62 | 20 | MQLQPFPQPQLPYPQPQLPY |
| 122 | alpha-gliadin | Wheat peptide W02 | Immunogenic | Deamidated | DQ2 | 62 | 20 | MQLQPFPQPELPYPQPQLPY |
| 123 | alpha-gliadin | Wheat peptide W02 | Immunogenic | Deamidated | DQ2 | 62 | 16 | QLQPFPQPELPYPQPQ |
| 124 | alpha-gliadin | Wheat peptide W02 | Immunogenic | Deamidated | DQ2 | 62 | 16 | ELQPFPQPELPYPQPQ |
| 125 | alpha-gliadin | Wheat peptide W02 | Immunogenic | Native | DQ2 | 62 | 12 | QPFPQPQLPYPQ |
| 126 | alpha-gliadin | Wheat peptide W02 | Immunogenic | Deamidated | DQ2 | 62 | 12 | QPFPQPELPYPQ |
| 127 | gamma-gliadin | Wheat peptide W01 | Immunogenic | Native | DQ2 | 62 | 20 | PQPFPPQQLPYPQPQLPYPQP |
| 128 | gamma-gliadin | Wheat peptide W01 | Immunogenic | Deamidated | DQ2 | 62 | 20 | PQPPPQQLPYPQPELPYPQP |
| 129 | gamma-gliadin | Wheat peptide W01 | Immunogenic | Deamidated | DQ2 | 62 | 12 | LPYPQPELPYPQ |
| 130 | alpha-gliadin | Wheat peptide W34 | Immunogenic | Native | DQ2 | 62 | 20 | VAHAIIMHQQQQQQEQKQQ |
| 131 | alpha-gliadin | Wheat peptide W34 | Immunogenic | Deamidated | DQ2 | 62 | 16 | VAHAIIMHQQQQQQE |
| 132 | alpha-gliadin | Analog of alpha-gliadin (p31-p49; A31) | Toxic | Native | DQ2 | 50 | 19 | AGQQQPFPQQQPYPQPQPF |
| 133 | alpha-gliadin | Analog of alpha-gliadin (p31-p49; A36) | Toxic | Native | DQ2 | 50 | 19 | LGQQQAFPPQQPYPQPQPF |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 134 | alpha-gliadin | alpha20-gliadin (p91-p106) | Immunogenic | Native | DQ2 | 8 | 16 | PQPFRPQQPYPQPQPQ |
| 135 | alpha-gliadin | alpha20-gliadin (p93-106; E97) | Immunogenic | Deamidated | DQ2 | 8 | 16 | PQPFREQPYPQPQPQPQ |
| 136 | alpha-gliadin | Glia-alpha20-gliadin (p93-p106) | Immunogenic | Native | DQ2 | 19 | 14 | PFRPQQPYPQPQPQ |
| 137 | alpha-gliadin | Glia-alpha20-gliadin (p93-p106; E97) | Immunogenic | Deamidated | DQ2 | 19 | 14 | PFRPEQPYPQPQPQ |
| 138 | alpha-gliadin | Glia-alpha20-gliadin (p96-106) minimal epitope | Immunogenic | Native | DQ2 | 19 | 11 | PQQPYPQPQPQ |
| 139 | alpha-gliadin | Glia-alpha20-gliadin (p96-106; E97) minimal epitope, synthetic | Immunogenic | Deamidated | DQ2 | 19 | 11 | PEQPYPQPQPQ |
| 140 | alpha-gliadin | alpha-gliadin(p123-p132) | Immunogenic | Native | DQ8 | 64, 30 | 10 | QUPCMDVVL |
| 141 | alpha-gliadin | alpha-gliadin (p206-p217) | Toxic | Native | DQ2(A1 B8 DR3 DQ2 and A24 B8 DR3 13 DQ2) | 35 | 12 | LGQGSFRPSQQN |
| 142 | alpha-gliadin | Peptide XT (1-55) | Toxic | Native | Unknown | 29 | 55 | VRVPVPQLQPQNPSQQQPQEQVPLVQQQQFLGQQQPFPPQQPYPQPFPSQQPY |
| 143 | alpha-gliadin | Peptide XT (p1-p30) | Toxic | Native | Unknown | 29 | 30 | VRVPVPQLQPQNPSQQQPQEQVPLVQQQF |
| 144 | alpha-gliadin | alpha-gliadin B 3142 (p3-p55) | Immunogenic, Toxic | Native | Unknown | 40 | 53 | VPVPQLQPQNPSQQQPQEQVPLVQQQFGGQQQPFPPQQPYPQPFPSQQPY |
| 146 | alpha-gliadin | alpha-gliadin p19 (p21-p40) | Immunogenic | Native | DQ2 | 34 | 20 | QVPLVQQQFLGQQQPFPPQ |
| 147 | alpha-gliadin | alpha-gliadin p134 | Immunogenic | Native | DQ2 (alpha1*0501, 131*0201) | 39 | 19 | QFLGQQQPFPPQQPYPQPQ |
| 148 | alpha-gliadin | alpha-gliadin p135 | Immunogenic | Native | DQ2 (alpha1*0501, 131*0201) | 39 | 18 | FLGQQQPFPPQQPYPQPQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 149 | alpha-gliadin | Peptide XT (p31-p55) | Immunogenic, Toxic | Native | Unknown | 10, 29 | 25 | LGQQQPFPPQQPYP QPQPFPSQQPY |
| 150 | alpha-gliadin | alpha-gliadin (p31-p49) | Immunogenic, Toxic | Native | DQ2 (alpha1*0501, 131*0201) | 39, 11, 49, 34 | 19 | LGQQQPFPPQQPYP QPQPF |
| 151 | alpha-gliadin | alpha-gliadin p126 | Immunogenic | Native | DQ2 (alpha1*0501, 131*0201) | 10, 39, 13, 15, 66, 79 | 17 | LGQQQPFPPQQPYP QPQ |
| 152 | alpha-gliadin | alpha-gliadin (p31-p43) | Immunogenic, Toxic | Native | HLA-DR | 10, 13, 15, 72, 79 | 13 | LGQQQPFPPQQPY |
| 153 | alpha-gliadin | alpha-gliadin CAB76960 (p253-p272) | Immunogenic | Native | DQ8 | 54 | 20 | AMCNVYIPPYCAMA PFGIFG |
| 154 | alpha-gliadin | alpha-gliadin (proline-rich domain) | Immunogenic | Native | Unknown | 42 | 16 | CPQPFPSQQPYLQL QG |
| 155 | alpha-gliadin | alpha-gliadin (p5-p22) (proline-rich domain) | Immunogenic | Native | Unknown | 42 | 18 | CPQLQPQNPSQQQP QEQG |
| 156 | alpha-gliadin | alpha-gliadin (p51-p70) | Toxic | Native | DQ2 | 37 | 20 | SQQPYLQLQPFPQP QLPYSQ |
| 157 | alpha-gliadin | Wheat peptide W08 | Immunogenic | Native | DQ2 | 62 | 20 | LQLQPFPQPQLPYS QPQPFR |
| 158 | alpha-gliadin | Wheat peptide W08 | Immunogenic | Deamidated | DQ2 | 62 | 20 | LQLQPFPQPELPYS QPQPFR |
| 159 | alpha-gliadin | Glia-alpha9 (p57-p71; S69) | Immunogenic | Native | DQ2 | 9 | 15 | QLQPFPQPQLPYSQ P |
| 160 | alpha-gliadin | DQ2-Glia-alpha1 epitope (p58-p72; S69) | Immunogenic | Native | DQ2 | 59 | 15 | LQPFPQPQLPYSQP Q |
| 161 | alpha-gliadin | DQ2-Glia-alpha1 epitope (p58-p72; S69 and E65) | Immunogenic | Deamidated | DQ2 | 59 | 15 | LQPFPQPELPYSQP Q |
| 162 | alpha-gliadin | DQ2-Glia-alpha1 epitope (p58-p72; S64 and S69) | Immunogenic | Native | DQ2 | 59 | 15 | LQPFPQSQLPYSQP Q |
| 163 | alpha-gliadin | DQ2-Glia-alpha1 epitope (p58-p72; S64, S69 and E65) | Immunogenic | Deamidated | DQ2 | 59 | 15 | LQPPPQSELPYSQP Q |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 164 | alpha-gliadin | Wheat peptide W08 | Immunogenic | Native | DQ2 | 62 | 12 | QPFPQPQLPYSQ |
| 165 | alpha-gliadin | Wheat peptide W08 | Immunogenic | Deamidated | DQ2 | 62 | 12 | QPFPQPELPYSQ |
| 166 | alpha-gliadin | Glia-alpha | Immunogenic | Native | DQ2 | 59 | 11 | PFPQPQLPYSQ |
| 167 | alpha-gliadin | Glia-alpha in Deamidated form | Immunogenic | Deamidated | DQ2 | 59 | 11 | PFPQPELPYSQ |
| 168 | alpha-gliadin | alpha-gliadin (p202-p220) | Toxic | Native | DQ2 | 11 | 19 | QQYPLGQGSFRPSQQNPQA |
| 169 | alpha-gliadin | alpha-gliadin CAB76961 (p251-p270) | Immunogenic | Native | DQ8 | 54 | 20 | VYIPPYCTIAPFGIFGTNYR |
| 170 | alpha-gliadin | Wheat peptide W13 | Immunogenic | Native | DQ2 | 62 | 20 | LQLQPFPQPQLPYLQPQPFR |
| 171 | alpha-gliadin | Wheat peptide W13 | Immunogenic | Deamidated | DQ2 | 62 | 20 | LQLQPFPQPELPYLQPQPFR |
| 172 | alpha-gliadin | Glia-alpha9 (p57-p71; L69) | Immunogenic | Native | DQ2 | 9 | 15 | QLQPFPQPQLPYLQP |
| 173 | alpha-gliadin | Wheat peptide W13 | Immunogenic | Native | DQ2 | 62 | 12 | QPFPQPQLPYLQ |
| 174 | alpha-gliadin | Wheat peptide W13 | Immunogenic | Deamidated | DQ2 | 62 | 12 | QPFPQPELPYLQ |
| 175 | alpha-gliadin | alpha-gliadin 4037 | Immunogenic | Native | Unknown | 60 | 17 | PPYCTIVPGIFGTNYR |
| 176 | alpha-gliadin | alpha-gliadin | Immunogenic | Native | DQ2 | 62 | 20 | LQLQPFPQPQLPYPQPQPFR |
| 177 | alpha-gliadin | alpha-Glia (p57-p73) | Immunogenic | Native | DQ2 | 57 | 17 | QLQPFPQPQLPYPQPQP |
| 178 | alpha-gliadin | alpha-Glia (p57-p73; E65) | Immunogenic | Deamidated | DQ2 | 57 | 17 | QLQPFPQPELPYPQPQP |
| 179 | alpha-gliadin | alpha-Glia (p57-p73; T65 and S73) | Immunogenic | Native | DQ2 | 57 | 17 | QLQPFPQPTLPYPQPQS |
| 180 | alpha-gliadin | alpha-gliadin (p57-p73; S73) | Immunogenic | Native | DQ2 | 28 | 17 | QLQPFPQPQLPYPQPQS |
| 181 | alpha-gliadin | alpha-gliadin (p57-p73; S73 and E65) | Immunogenic | Deamidated | DQ2 | 28 | 17 | QLQPFPQPELPYPQPQS |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 182 | alpha-gliadin | Wheat peptide W09 | Immunogenic | Native | DQ2 | 62 | 20 | LQFFPQPQPFLPQLPYPQPQ |
| 183 | alpha-gliadin | alpha-Glia AG11 (p78-p95) | Immunogenic | Native | DQ2 | 57 | 17 | PQQPFLPQLPYPQPQS |
| 184 | alpha-gliadin | alpha-Glia AG11 (p78-p95; E86) | Immunogenic | Deamidated | DQ2 | 57 | 17 | PQPQPFLPELPYPQPQS |
| 185 | alpha-gliadin | Wheat peptide W09 | Immunogenic | Native | DQ2 | 62 | 14 | QPQPFLPQLPYPQP |
| 186 | alpha-gliadin | Wheat peptide W09 | Immunogenic | Deamidated | DQ2 | 62 | 14 | EPQPFLPELPYPQP |
| 187 | alpha-gliadin | Wheat peptide W09 | Immunogenic | Native | DQ2 | 62 | 12 | PQPFLPQLPYPQ |
| 188 | alpha-gliadin | alpha-gliadin p211 | Immunogenic | Native | DQ2 | 34 | 20 | FPGQQQFPPQQPYPQPQPF |
| 189 | alpha-gliadin | alpha-Glia AG12 (p82-p98) | Immunogenic | Native | DQ2 | 57 | 17 | PQPQPFPPQLPYPQPQS |
| 190 | alpha-gliadin | alpha-Glia AG12 (p82-p98; E90) | Immunogenic | Deamidated | DQ2 | 57 | 17 | PQQPFPPELPYPQPQS |
| 191 | omega-gliadin | Gliadin AAG17702 (p80-p99) | Immunogenic | Native | DQ8 | 54 | 20 | PFTQPQQPTPIQPQQPFPQQ |
| 192 | omega-gliadin | Wheat peptide W27 | Immunogenic | Native | DQ2 | 62 | 11 | PFTQPQQPTPI |
| 193 | omega-gliadin | Gliadin AAG17702 (p88-p107) | Immunogenic | Native | DQ8 | 54 | 20 | TPIQPQQPFPQQPQPQQPF |
| 194 | omega-gliadin | Wheat peptide W25 | Immunogenic | Native | DQ2 | 62 | 11 | TPIQPQQPFPQ |
| 195 | omega-gliadin | Wheat peptide W30; Rye peptide R28 | Immunogenic | Native | DQ2 | 62 | 12 | PQQPFPQQQQP |
| 197 | omega-gliadin | omega-gliadin | Immunogenic | Native | DQ2 | 62 | 20 | PQQQQPQQPFPQPQQPFPW |
| 198 | omega-gliadin | Epitope DQ2-omega-I/II | Immunogenic | Native | DQ2 | 62 | 20 | PQQPFQPFPQQPFPQQPFPWQPQ |
| 199 | omega-gliadin | p4-p18 omega-gliadin of AAG17702 (p81-p102) | Immunogenic | Native | DQ2 | 62 | 15 | PQQPQQPFPQQQQPF |
| 200 | omega-gliadin | p5-p19 omega-gliadin of AAG17702 (p81-p102) | Immunogenic | Native | DQ2 | 62 | 15 | QQPQQPFPQPQQPFP |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 201 | omega-gliadin | DQ2-omega-1 omega-Glia (p102-p118) | Immunogenic | Native | DQ2 | 57 | 17 | QPQQPFPQQPQQPFP WQP |
| 202 | omega-gliadin | DQ2-omega-1 omega-Glia (p102-p118; E104) | Immunogenic | Deamidated | DQ2 | 57 | 17 | QPEQPFPQQPQQPFP WQP |
| 203 | omega-gliadin | Wheat peptide W03, W19, B01 | Immunogenic | Deamidated | DQ2 | 62, 86 | 17 | QPEQPFPQPEQPFP WQP |
| 204 | omega-gliadin | omega-Glia 17mer | Immunogenic | Deamidated | DQ2.5 | 61 | 17 | QPQQPFPQPEQPFP WQP |
| 205 | omega-gliadin | omega-gliadin AAG17702 substituted by Lysine (p89-p102; E95 K89) | Immunogenic | Native | DQ2 | 62 | 14 | KPFPQPEQPFPWQP |
| 206 | omega-gliadin | omega-gliadin AAG17702 substituted by Lysine (p89-p102; E95 K90) | Immunogenic | Native | DQ2 | 62 | 14 | QKFPQPEQPFPWQP |
| 207 | omega-gliadin | omega-gliadin AAG17702 substituted by Lysine (p89-p102; E95 K91) | Immunogenic | Native | DQ2 | 62 | 14 | QPKPQPEQPFPWQP |
| 208 | omega-gliadin | omega-gliadin AAG17702 substituted by Lysine (p89-p102; E95 K99) | Immunogenic | Native | DQ2 | 62 | 14 | QPFPQPEQPFKWQP |
| 209 | omega-gliadin | omega-gliadin AAG17702 substituted by Lysine (p89-p102; E95 K100) | Immunogenic | Native | DQ2 | 62 | 14 | QPFPQPEQPFPKQP |
| 210 | omega-gliadin | omega-gliadin AAG17702 substituted by Lysine (p89-p102; E95 K101) | Immunogenic | Native | DQ2 | 62 | 14 | QPFPQPEQPFPWKP |
| 211 | omega-gliadin | omega-gliadin AAG17702 substituted by Lysine (p89-p102; E95 K102) | Immunogenic | Native | DQ2 | 62 | 14 | QPFPQPEQPFPWQK |
| 212 | omega-gliadin | p6-p20 omega-gliadin of AAG17702 (p81-p102) | Immunogenic | Native | DQ2 | 62 | 15 | QPQQPFPQQPQPFP W |
| 213 | omega-gliadin | p7-p21 omega-gliadin of AAG17702 (p81-p102) | Immunogenic | Native | DQ2 | 62 | 15 | PQQPFPQQPQPFPW Q |
| 214 | omega-gliadin | p8-p22 omega-gliadin of AAG17702 (p81-p102), Wheat peptide W3 | Immunogenic | Native | DQ2 | 62 | 15 | QQPFPQQPQQPFPWQ P |
| 215 | omega-gliadin | Wheat peptide W03 | Immunogenic | Deamidated | DQ2 | 62 | 15 | EQPFPQPEQPFPWQ P |
| 216 | omega-gliadin | Wheat peptide W03, W19, Barley peptide B01 | Immunogenic | Native | DQ2 | 62 | 20 | QPFPQPQQPFPWQP QQPFPQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 217 | omega-gliadin | Wheat peptide W03, W19, Barley peptide B01 | Immunogenic | Deamidated | DQ2 | 62 | 20 | QPFPQPEQPFPWQPQQPFPQ |
| 218 | omega-gliadin | Wheat peptide W03, Barley peptide B01 | Immunogenic | Native | DQ2 | 62 | 12 | QPFPQPQQPFPW |
| 219 | omega-gliadin | Wheat peptide W03, Barley peptide B01 | Immunogenic | Deamidated | DQ2 | 62 | 12 | QPFPQPEQPFPW |
| 220 | omega-II | gliadinDQ2.5_glia_omega 2 | Immunogenic | Deamidated | DQ2.5 | 88, 90, 62 | 9 | PQPEQPFPW |
| 221 | omega-II | gliadinDQ2.5_glia_omega 2 | Immunogenic | Native | DQ2 | 88, 90, 62 | 9 | PQQPFPW |
| 222 | omega-gliadin | Wheat peptide W19, Barley peptide B19 | Immunogenic | Native | DQ2 | 62 | 12 | PFPWQPQQPFPQ |
| 223 | omega-gliadin | Wheat peptide W19 | Immunogenic | Deamidated | DQ2 | 62 | 12 | PFPWQPEQPFPQ |
| 224 | omega-gliadin | Wheat peptide W30 | Immunogenic | Native | DQ2 | 62 | 20 | PLQPQQPFPQQPQQPFPQPQ |
| 225 | omega-gliadin | omega-gliadin | Immunogenic | Native | DQ2 | 62 | 20 | FPQQPQQPFPQLPFPQQS |
| 226 | omega-gliadin | Wheat peptide W06 | Immunogenic | Native | DQ2 | 62 | 20 | QQQQPFPQPQLPFPQQSEQ |
| 227 | omega-gliadin | Wheat peptide W06 | Immunogenic | Native | DQ2 | 62 | 12 | QPFPQPQLPFPQ |
| 228 | omega-gliadin | Gliadin AAG17702 p173-p192 | Immunogenic | Native | DQ8 | 54 | 20 | QQPFPQQPQQPFPQPQQPIP |
| 229 | omega-gliadin | Wheat peptide W32, Barley peptide B25, Rye peptide R26 | Immunogenic | Native | DQ2 | 62 | 12 | PFPQQPQQPFPQ |
| 230 | omega-gliadin | Wheat peptide W04 | Immunogenic | Native | DQ2 | 62 | 20 | PQQPQQPFPQPIPVQPQ |
| 231 | omega-gliadin | Wheat peptide W04 | Immunogenic | Native | DQ2 | 62 | 11 | PFPQPQQPIPV |
| 232 | omega-gliadin | Gliadin AAG17702 p186-p205 | Immunogenic | Native | DQ8 | 54 | 20 | QPQQPIPVQPQQSFPQQSQQ |
| 233 | omega-gliadin | Wheat peptide W20 | Immunogenic | Native | DQ2 | 62 | 20 | FPELQQPIPQQPQQPFPLQP |
| 234 | omega-gliadin | Wheat peptide W20 | Immunogenic | Native | DQ2 | 62 | 12 | PIPQQPQQPFPL |
| 235 | omega-gliadin | Gliadin AAG17702 p225-p244 | Immunogenic | Native | DQ8 | 54 | 20 | PQQPQQPFPLQPQQPFPQQP |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 236 | omega-gliadin | Wheat peptide W26, Barley peptide B20 | Immunogenic | Native | DQ2 | 62 | 12 | PFPLQPQPFPQ |
| 237 | omega-gliadin | Gliadin AAG17702 p239-p258 | Immunogenic | Native | DQ8 | 54 | 20 | PFPQQPQQPFPQQPQQSFPQ |
| 246 | omega5-liadin/ LMW glutenin | Glu-5 peptide epitope in native form | Immunogenic | Native | DQ2 | 21 | 12 | QQQQIPQQPQQF |
| 247 | omega5-liadin/ LMW glutenin | Glu-5 peptide epitope in native form | Immunogenic | Native | DQ2 | 21 | 12 | QQQQLPQQPQQF |
| 248 | omega5-liadin/ LMW glutenin | Glu-5 peptide epitope in Deamidated form | Immunogenic | Deamidated | DQ2 | 21 | 12 | QEQQIPEQPQQF |
| 249 | omega5-liadin/ LMW glutenin | Glu-5 peptide epitope in Deamidated form | Immunogenic | Deamidated | DQ2 | 21 | 12 | QEQQLPEQPQQF |
| 252 | omega5-liadin/ LMW glutenin | CAUTION 100% matches with 4 fungal proteins but multiple epitopes on Triticum Glu-5 minimal epitope in native form | Immunogenic | Native | DQ2 | 19 | 9 | QIPQQPQQF |
| 253 | omega5-liadin/ LMW glutenin | Glu-5 minimal epitope in Deamidated form | Immunogenic | Deamidated | DQ2 | 19 | 9 | QIPEQPQQF |
| 254 | omega5-liadin/ LMW glutenin | CAUTION 100% match with fungal and parasite proteins, less with Glu-5 minimal epitope in native form | Immunogenic | Native | DQ2 | 19 | 9 | QLPQQPQQF |
| 255 | omega5-liadin/ LMW glutenin | Glu-5 minimal epitope in Deamidated form | Immunogenic | Deamidated | DQ2 | 19 | 9 | QLPEQPQQF |
| 256 | omega5-liadin/ LMW glutenin | Glu-5 minimal epitope in Deamidated form | Immunogenic | Deamidated | DQ2 (DQ2.2 and DQ2.5) | 44 | 9 | ELPEQPQQF |
| 257 | omega5-liadin/ LMW glutenin | Glu-5 minimal epitope in Deamidated form | Immunogenic | Deamidated | DQ2 (DQ2.2 and DQ2.5) | 44 | 9 | ELPEQPQQF |
| 258 | gamma-gliadin or LMW glutenin | Glu-5 | Immunogenic | Native | DQ2 | 19 | 21 | QQISQPQIPQQQQIPQQPQQF |
| 259 | gamma-gliadin or LMW glutenin | Glu-5 in Deamidated form | Immunogenic | Deamidated | DQ2 | 19 | 21 | QEISQPQIPQQQQIPQQPQQF |
| 260 | gamma-gliadin or LMW glutenin | Glu-5 in Deamidated form | Immunogenic | Deamidated | DQ2 | 19 | 21 | QQISQPEIPQQQQIPQQPQQF |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 261 | gamma-gliadin or LMW glutenin | Glu-5 in Deamidated form | Immunogenic | Deamidated | DQ2 | 19 | 21 | QQISQPQIPQEQQI PQQPQQF |
| 262 | gamma-gliadin or LMW glutenin | Glu-5 in Deamidated form | Immunogenic | Deamidated | DQ2 | 19 | 21 | QQISQPQIPQQQEI PQQPQQF |
| 263 | gamma-gliadin or LMW glutenin | Glu-5 in Deamidated form | Immunogenic | Deamidated | DQ2 | 19 | 21 | QEISQPEIPQQQI PQQPQQF |
| 264 | gamma-gliadin or LMW glutenin | Glu-5 in Deamidated form | Immunogenic | Deamidated | DQ2 | 19 | 21 | QEISQPQIPQEQQI PQQPQQF |
| 265 | gamma-gliadin or LMW glutenin | Glu-5 in Deamidated form | Immunogenic | Deamidated | DQ2 | 19 | 21 | QEISQPQIPQQQEI PQQPQQF |
| 266 | gamma-gliadin or LMW glutenin | Glu-5 in Deamidated form | Immunogenic | Deamidated | DQ2 | 19 | 21 | QEISQPEIPQQQI PQQPQQF |
| 267 | gamma-gliadin or LMW glutenin | Glu-5 in Deamidated form | Immunogenic | Deamidated | DQ2 | 19 | 21 | QQISQPQIPQQQEI PQQPQQF |
| 268 | gamma-gliadin or LMW glutenin | Glu-5 in Deamidated form | Immunogenic | Deamidated | DQ2 | 19 | 21 | QQISQPQIPQEQQI PQQPQQF |
| 269 | gamma-gliadin or LMW glutenin | Glu-5 in Deamidated form | Immunogenic | Deamidated | DQ2 | 19 | 21 | QEISQPEIPQEQQI PQQPQQF |
| 270 | gamma-gliadin or LMW glutenin | Glu-5 in Deamidated form | Immunogenic | Deamidated | DQ2 | 19 | 21 | QQISQPQIPQQQEI PQQPQQF |
| 271 | gamma-gliadin or LMW glutenin | Glu-5 in Deamidated form | Immunogenic | Deamidated | DQ2 | 19 | 21 | QEISQPEIPQEQEI PQQPQQF |
| 272 | gamma-gliadin or LMW glutenin | Glu-5 in Deamidated form | Immunogenic | Deamidated | DQ2 | 19 | 21 | QQISQPEIPQEQEI PQQPQQF |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 273 | gamma-gliadin or LMW glutenin | Glu-5 in Deamidated form | Immunogenic | Deamidated | DQ2 | 19 | 21 | QEISQPEIPQEQEIPQQPQQF |
| 274 | gamma-gliadin or LMW glutenin | Glu-5 | Immunogenic | Native | DQ2 | 19 | 21 | QQISQPQLPQQQIPQQPQQF |
| 275 | gamma-gliadin or LMW glutenin | Glu-5 in Deamidated form | Immunogenic | Deamidated | DQ2 | 19 | 21 | QQISQPQLPQQQIPQQPQQF |
| 276 | gamma-gliadin or LMW glutenin | Glu-5 in Deamidated form | Immunogenic | Deamidated | DQ2 | 19 | 21 | QQISQPELPQQQFPQQPQQF |
| 277 | gamma-gliadin or LMW glutenin | Glu-5 in Deamidated form | Immunogenic | Deamidated | DQ2 | 19 | 21 | QQISQPQLPQEQQFPQQPQQF |
| 278 | gamma-gliadin or LMW glutenin | Glu-5 in Deamidated form | Immunogenic | Deamidated | DQ2 | 19 | 21 | QEISQPQLPQQQIPQQPQQF |
| 279 | gamma-gliadin or LMW glutenin | Glu-5 in Deamidated form | Immunogenic | Deamidated | DQ2 | 19 | 21 | QEISQPELPQQQIPQQPQQF |
| 280 | gamma-gliadin or LMW glutenin | Glu-5 in Deamidated form | Immunogenic | Deamidated | DQ2 | 19 | 21 | QQISQPQLPQEQQIPQQPQQF |
| 281 | gamma-gliadin or LMW glutenin | Glu-5 in Deamidated form | Immunogenic | Deamidated | DQ2 | 19 | 21 | QEISQPQLPQQQEIPQQPQQF |
| 282 | gamma-gliadin or LMW glutenin | Glu-5 in Deamidated form | Immunogenic | Deamidated | DQ2 | 19 | 21 | QQISQPELPQQQIPQQPQQF |
| 283 | gamma-gliadin or LMW glutenin | Glu-5 in Deamidated form | Immunogenic | Deamidated | DQ2 | 19 | 21 | QQISQPELPQQQEIPQQPQQF |
| 284 | gamma-gliadin or LMW glutenin | Glu-5 in Deamidated form | Immunogenic | Deamidated | DQ2 | 19 | 21 | QQISQPQLPQEQEIPQQPQQF |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 285 | gamma-gliadin or LMW glutenin | Glu-5 in Deamidated form | Immunogenic | Deamidated | DQ2 | 19 | 21 | QEISQPELPQEQQI PQQPQQF |
| 286 | gamma-gliadin or LMW glutenin | Glu-5 in Deamidated form | Immunogenic | Deamidated | DQ2 | 19 | 21 | QEISQPELPQQQEI PQQPQQF |
| 287 | gamma-gliadin or LMW glutenin | Glu-5 in Deamidated form | Immunogenic | Deamidated | DQ2 | 19 | 21 | QEISQPQLPQEQEI PQQPQQF |
| 288 | gamma-gliadin or LMW glutenin | Glu-5 in Deamidated form | Immunogenic | Deamidated | DQ2 | 19 | 21 | QQISQPELPQEQEI PQQPQQF |
| 289 | gamma-gliadin or LMW glutenin | Glu-5 in Deamidated form | Immunogenic | Deamidated | DQ2 | 19 | 21 | QEISQPELPQEQEI PQQPQQF |
| 290 | gamma-gliadin or LMW glutenin | Glu-5 | Immunogenic | Native | DQ2 | 19 | 21 | QQISQPQIPQQQL PQQPQQF |
| 291 | gamma-gliadin or LMW glutenin | Glu-5 in Deamidated form | Immunogenic | Deamidated | DQ2 | 19 | 21 | QEISQPQIPQQQL PQQPQQF |
| 292 | gamma-gliadin or LMW glutenin | Glu-5 in Deamidated form | Immunogenic | Deamidated | DQ2 | 19 | 21 | QQISQPEIPQQQL PQQPQQF |
| 293 | gamma-gliadin or LMW glutenin | Glu-5 in Deamidated form | Immunogenic | Deamidated | DQ2 | 19 | 21 | QQISQPQIPQEQL PQQPQQF |
| 294 | gamma-gliadin or LMW glutenin | Glu-5 in Deamidated form | Immunogenic | Deamidated | DQ2 | 19 | 21 | QQISQPQIPQQQEL PQQPQQF |
| 295 | gamma-gliadin or LMW glutenin | Glu-5 in Deamidated form | Immunogenic | Deamidated | DQ2 | 19 | 21 | QEISQPEIPQQQL PQQPQQF |
| 296 | gamma-gliadin or LMW glutenin | Glu-5 in Deamidated form | Immunogenic | Deamidated | DQ2 | 19 | 21 | QEISQPQIPQEQQL PQQPQQF |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 297 | gamma-gliadin or LMW glutenin | Glu-5 in Deamidated form | Immunogenic | Deamidated | DQ2 | 19 | 21 | QEISQPQIPQQQEL PQQPQQF |
| 298 | gamma-gliadin or LMW glutenin | Glu-5 in Deamidated form | Immunogenic | Deamidated | DQ2 | 19 | 21 | QQISQPEIPQEQQL PQQPQQF |
| 299 | gamma-gliadin or LMW glutenin | Glu-5 in Deamidated form | Immunogenic | Deamidated | DQ2 | 19 | 21 | QQISQPEIPQQQEL PQQPQQF |
| 300 | gamma-gliadin or LMW glutenin | Glu-5 in Deamidated form | Immunogenic | Deamidated | DQ2 | 19 | 21 | QQISQPQIPQEQEL PQQPQQF |
| 301 | gamma-gliadin or LMW glutenin | Glu-5 in Deamidated form | Immunogenic | Deamidated | DQ2 | 19 | 21 | QEISQPEIPQEQQL PQQPQQF |
| 302 | gamma-gliadin or LMW glutenin | Glu-5 in Deamidated form | Immunogenic | Deamidated | DQ2 | 19 | 21 | QEISQPEIPQQQEL PQQPQQF |
| 303 | gamma-gliadin or LMW glutenin | Glu-5 in Deamidated form | Immunogenic | Deamidated | DQ2 | 19 | 21 | QQISQPEIPQEQEL PQQPQQF |
| 304 | gamma-gliadin or LMW glutenin | Glu-5 in Deamidated form | Immunogenic | Deamidated | DQ2 | 19 | 21 | QQISQPEIPQQQEL PQQPQQF |
| 305 | gamma-gliadin or LMW glutenin | Glu-5 in Deamidated form | Immunogenic | Deamidated | DQ2 | 19 | 21 | QEISQPEIPQEQEL PQQPQQF |
| 306 | gamma-gliadin or LMW glutenin | Glu-5 | Immunogenic | Native | DQ2 | 19 | 21 | QQLSQPQIPQQQI PQQPQQF |
| 307 | gamma-gliadin or LMW glutenin | Glu-5 in Deamidated form | Immunogenic | Deamidated | DQ2 | 19 | 21 | QELSQPQIPQQQI PQQPQQF |
| 308 | gamma-gliadin or LMW glutenin | Glu-5 in Deamidated form | Immunogenic | Deamidated | DQ2 | 19 | 21 | QQLSQPEIPQQQI PQQPQQF |

TABLE 6-continued

The sequences are, in the order presented, SEQ ID NOs: 1000-2012.

| ID | Type | Description | Toxicity Form | HLADQ | Refs | SeqLen | Sequence |
|---|---|---|---|---|---|---|---|
| 309 | gamma-gliadin or LMW glutenin | Glu-5 in Deamidated form | Immunogenic Deamidated | DQ2 | 19 | 21 | QQLSQPQIPQEQQI PQQPQQF |
| 310 | gamma-gliadin or LMW glutenin | Glu-5 in Deamidated form | Immunogenic Deamidated | DQ2 | 19 | 21 | QQLSQPQIPQQQEI PQQPQQF |
| 311 | gamma-gliadin or LMW glutenin | Glu-5 in Deamidated form | Immunogenic Deamidated | DQ2 | 19 | 21 | QELSQPEIPQQQI PQQPQQF |
| 312 | gamma-gliadin or LMW glutenin | Glu-5 in Deamidated form | Immunogenic Deamidated | DQ2 | 19 | 21 | QELSQPQIPQEQQI PQQPQQF |
| 313 | gamma-gliadin or LMW glutenin | Glu-5 in Deamidated form | Immunogenic Deamidated | DQ2 | 19 | 21 | QELSQPQIPQQQEI PQQPQQF |
| 314 | gamma-gliadin or LMW glutenin | Glu-5 in Deamidated form | Immunogenic Deamidated | DQ2 | 19 | 21 | QELSQPEIPQEQQI PQQPQQF |
| 315 | gamma-gliadin or LMW glutenin | Glu-5 in Deamidated form | Immunogenic Deamidated | DQ2 | 19 | 21 | QQLSQPEIPQQQEI PQQPQQF |
| 316 | gamma-gliadin or LMW glutenin | Glu-5 in Deamidated form | Immunogenic Deamidated | DQ2 | 19 | 21 | QQLSQPQIPQEQEI PQQPQQF |
| 317 | gamma-gliadin or LMW glutenin | Glu-5 in Deamidated form | Immunogenic Deamidated | DQ2 | 19 | 21 | QELSQPEIPQEQQI PQQPQQF |
| 318 | gamma-gliadin or LMW glutenin | Glu-5 in Deamidated form | Immunogenic Deamidated | DQ2 | 19 | 21 | QQLSQPEIPQQQEI PQQPQQF |
| 319 | gamma-gliadin or LMW glutenin | Glu-5 in Deamidated form | Immunogenic Deamidated | DQ2 | 19 | 21 | QELSQPEIPQEQEI PQQPQQF |
| 320 | gamma-gliadin or LMW glutenin | Glu-5 in Deamidated form | Immunogenic Deamidated | DQ2 | 19 | 21 | QQLSQPEIPQEQEI PQQPQQF |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 321 | gamma-gliadin or LMW glutenin | Glu-5 in Deamidated form | Immunogenic | Deamidated | DQ2 | 19 | 21 | QELSQPEIPQEQEI PQQPQQF |
| 322 | gamma-gliadin or LMW glutenin | Glu-5 | Immunogenic | Native | DQ2 | 19 | 21 | QQLSQPQLPQQQQI PQQPQQF |
| 323 | gamma-gliadin or LMW glutenin | Glu-5 in Deamidated form | Immunogenic | Deamidated | DQ2 | 19 | 21 | QELSQPQLPQQQQI PQQPQQF |
| 324 | gamma-gliadin or LMW glutenin | Glu-5 in Deamidated form | Immunogenic | Deamidated | DQ2 | 19 | 21 | QQLSQPELPQQQQI PQQPQQF |
| 325 | gamma-gliadin or LMW glutenin | Glu-5 in Deamidated form | Immunogenic | Deamidated | DQ2 | 19 | 21 | QQLSQPQLPQEQQI PQQPQQF |
| 326 | gamma-gliadin or LMW glutenin | Glu-5 in Deamidated form | Immunogenic | Deamidated | DQ2 | 19 | 21 | QELSQPQLPQQQQI PQQPQQF |
| 327 | gamma-gliadin or LMW glutenin | Glu-5 in Deamidated form | Immunogenic | Deamidated | DQ2 | 19 | 21 | QELSQPQLPQQQQI PQQPQQF |
| 328 | gamma-gliadin or LMW glutenin | Glu-5 in Deamidated form | Immunogenic | Deamidated | DQ2 | 19 | 21 | QELSQPQLPQEQQI PQQPQQF |
| 329 | gamma-gliadin or LMW glutenin | Glu-5 in Deamidated form | Immunogenic | Deamidated | DQ2 | 19 | 21 | QELSQPQLPQQQQI PQQPQQF |
| 330 | gamma-gliadin or LMW glutenin | Glu-5 in Deamidated form | Immunogenic | Deamidated | DQ2 | 19 | 21 | QQLSQPELPQQQEI PQQPQQF |
| 331 | gamma-gliadin or LMW glutenin | Glu-5 in Deamidated form | Immunogenic | Deamidated | DQ2 | 19 | 21 | QQLSQPELPQQQEI PQQPQQF |
| 332 | gamma-gliadin or LMW glutenin | Glu-5 in Deamidated form | Immunogenic | Deamidated | DQ2 | 19 | 21 | QQLSQPQLPQEQEI PQQPQQF |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 333 | gamma-gliadin or LMW glutenin | Glu-5 in Deamidated form | Immunogenic | Deamidated | DQ2 | 19 | 21 | QELSQPELPQEQQIPQQPQQF |
| 334 | gamma-gliadin or LMW glutenin | Glu-5 in Deamidated form | Immunogenic | Deamidated | DQ2 | 19 | 21 | QELSQPELPQQQEIPQQPQQF |
| 335 | gamma-gliadin or LMW glutenin | Glu-5 in Deamidated form | Immunogenic | Deamidated | DQ2 | 19 | 21 | QELSQPQLPQEQEIPQQPQQF |
| 336 | gamma-gliadin or LMW glutenin | Glu-5 in Deamidated form | Immunogenic | Deamidated | DQ2 | 19 | 21 | QQLSQPELPQEQEIPQQPQQF |
| 337 | gamma-gliadin or LMW glutenin | Glu-5 in Deamidated form | Immunogenic | Deamidated | DQ2 | 19 | 21 | QELSQPELPQEQEIPQQPQQF |
| 338 | gamma-gliadin or LMW glutenin | Glu-5 | Immunogenic | Native | DQ2 | 19 | 21 | QQLSQPQIPQQQLPQQPQQF |
| 339 | gamma-gliadin or LMW glutenin | Glu-5 in Deamidated form | Immunogenic | Deamidated | DQ2 | 19 | 21 | QELSQPQIPQQQLPQQPQQF |
| 340 | gamma-gliadin or LMW glutenin | Glu-5 in Deamidated form | Immunogenic | Deamidated | DQ2 | 19 | 21 | QQLSQPEIPQQQLPQQPQQF |
| 341 | gamma-gliadin or LMW glutenin | Glu-5 in Deamidated form | Immunogenic | Deamidated | DQ2 | 19 | 21 | QQLSQPQIPQEQLPQQPQQF |
| 342 | gamma-gliadin or LMW glutenin | Glu-5 in Deamidated form | Immunogenic | Deamidated | DQ2 | 19 | 21 | QQLSQPQIPQQQELPQQPQQF |
| 343 | gamma-gliadin or LMW glutenin | Glu-5 in Deamidated form | Immunogenic | Deamidated | DQ2 | 19 | 21 | QELSQPEIPQQQLPQQPQQF |
| 344 | gamma-gliadin or LMW glutenin | Glu-5 in Deamidated form | Immunogenic | Deamidated | DQ2 | 19 | 21 | QELSQPQIPQEQQLPQQPQQF |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 345 | gamma-gliadin or LMW glutenin | Glu-5 in Deamidated form | Immunogenic | Deamidated | DQ2 | 19 | 21 | QELSQPQIPQQQEL PQQPQQF |
| 346 | gamma-gliadin or LMW glutenin | Glu-5 in Deamidated form | Immunogenic | Deamidated | DQ2 | 19 | 21 | QQLSQPEIPQEQQL PQQPQQF |
| 347 | gamma-gliadin or LMW glutenin | Glu-5 in Deamidated form | Immunogenic | Deamidated | DQ2 | 19 | 21 | QQLSQPEIPQQQEL PQQPQQF |
| 348 | gamma-gliadin or LMW glutenin | Glu-5 in Deamidated form | Immunogenic | Deamidated | DQ2 | 19 | 21 | QQLSQPQIPQEQEL PQQPQQF |
| 349 | gamma-gliadin or LMW glutenin | Glu-5 in Deamidated form | Immunogenic | Deamidated | DQ2 | 19 | 21 | QELSQPEIPQEQQL PQQPQQF |
| 350 | gamma-gliadin or LMW glutenin | Glu-5 in Deamidated form | Immunogenic | Deamidated | DQ2 | 19 | 21 | QELSQPEIPQQQEL PQQPQQF |
| 351 | gamma-gliadin or LMW glutenin | Glu-5 in Deamidated form | Immunogenic | Deamidated | DQ2 | 19 | 21 | QQLSQPEIPQEQEL PQQPQQF |
| 352 | gamma-gliadin or LMW glutenin | Glu-5 in Deamidated form | Immunogenic | Deamidated | DQ2 | 19 | 21 | QELSQPEIPQEQEL PQQPQQF |
| 353 | gamma-gliadin or LMW glutenin | Glu-5 | Immunogenic | Native | DQ2 | 19 | 21 | QQISQPQLPQQQQL PQQPQQF |
| 354 | gamma-gliadin or LMW glutenin | Glu-5 in Deamidated form | Immunogenic | Deamidated | DQ2 | 19 | 21 | QEISQPQLPQQQQL PQQPQQF |
| 355 | gamma-gliadin or LMW glutenin | Glu-5 in Deamidated form | Immunogenic | Deamidated | DQ2 | 19 | 21 | QQISQPELPQQQQL PQQPQQF |
| 356 | gamma-gliadin or LMW glutenin | Glu-5 in Deamidated form | Immunogenic | Deamidated | DQ2 | 19 | 21 | QQISQPELPQQQQL PQQPQQF |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 357 | gamma-gliadin or LMW glutenin | Glu-5 in Deamidated form | Immunogenic | Deamidated | DQ2 | 19 | 21 | QQISQPQLPQEQQLPQQPQQF |
| 358 | gamma-gliadin or LMW glutenin | Glu-5 in Deamidated form | Immunogenic | Deamidated | DQ2 | 19 | 21 | QQISQPQLPQQQELPQQPQQF |
| 359 | gamma-gliadin or LMW glutenin | Glu-5 in Deamidated form | Immunogenic | Deamidated | DQ2 | 19 | 21 | QEISQPELPQQQLPQQPQQF |
| 360 | gamma-gliadin or LMW glutenin | Glu-5 in Deamidated form | Immunogenic | Deamidated | DQ2 | 19 | 21 | QEISQPQLPQEQQLPQQPQQF |
| 361 | gamma-gliadin or LMW glutenin | Glu-5 in Deamidated form | Immunogenic | Deamidated | DQ2 | 19 | 21 | QEISQPQLPQQQELPQQPQQF |
| 362 | gamma-gliadin or LMW glutenin | Glu-5 in Deamidated form | Immunogenic | Deamidated | DQ2 | 19 | 21 | QQISQPELPQQQLPQQPQQF |
| 363 | gamma-gliadin or LMW glutenin | Glu-5 in Deamidated form | Immunogenic | Deamidated | DQ2 | 19 | 21 | QQISQPELPQQQELPQQPQQF |
| 364 | gamma-gliadin or LMW glutenin | Glu-5 in Deamidated form | Immunogenic | Deamidated | DQ2 | 19 | 21 | QQISQPQLPQEQELPQQPQQF |
| 365 | gamma-gliadin or LMW glutenin | Glu-5 in Deamidated form | Immunogenic | Deamidated | DQ2 | 19 | 21 | QEISQPELPQEQQLPQQPQQF |
| 366 | gamma-gliadin or LMW glutenin | Glu-5 in Deamidated form | Immunogenic | Deamidated | DQ2 | 19 | 21 | QEISQPELPQQQELPQQPQQF |
| 367 | gamma-gliadin or LMW glutenin | Glu-5 in Deamidated form | Immunogenic | Deamidated | DQ2 | 19 | 21 | QEISQPQLPQEQELPQQPQQF |
| 368 | gamma-gliadin or LMW glutenin | Glu-5 in Deamidated form | Immunogenic | Deamidated | DQ2 | 19 | 21 | QQISQPELPQEQELPQQPQQF |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 369 | gamma-gliadin or LMW glutenin | Glu-5 in Deamidated form | Immunogenic | Deamidated | DQ2 | 19 | 21 | QEISQPELPQEQEL PQQPQQF |
| 370 | gamma-gliadin or LMW glutenin | Glu-5 | Immunogenic | Native | DQ2 | 19 | 21 | QQLSQPQLPQQQQL PQQPQQF |
| 371 | gamma-gliadin or LMW glutenin | Glu-5 in Deamidated form | Immunogenic | Deamidated | DQ2 | 19 | 21 | QELSQPQLPQQQQL PQQPQQF |
| 372 | gamma-gliadin or LMW glutenin | Glu-5 in Deamidated form | Immunogenic | Deamidated | DQ2 | 19 | 21 | QQLSQPELPQQQQL PQQPQQF |
| 373 | gamma-gliadin or LMW glutenin | Glu-5 in Deamidated form | Immunogenic | Deamidated | DQ2 | 19 | 21 | QQLSQPQLPQQQEL PQQPQQF |
| 374 | gamma-gliadin or LMW glutenin | Glu-5 in Deamidated form | Immunogenic | Deamidated | DQ2 | 19 | 21 | QELSQPELPQQQQL PQQPQQF |
| 375 | gamma-gliadin or LMW glutenin | Glu-5 in Deamidated form | Immunogenic | Deamidated | DQ2 | 19 | 21 | QELSQPQLPQQQEL PQQPQQF |
| 376 | gamma-gliadin or LMW glutenin | Glu-5 in Deamidated form | Immunogenic | Deamidated | DQ2 | 19 | 21 | QQLSQPELPQEQQL PQQPQQF |
| 377 | gamma-gliadin or LMW glutenin | Glu-5 in Deamidated form | Immunogenic | Deamidated | DQ2 | 19 | 21 | QELSQPQLPQQQEL PQQPQQF |
| 378 | gamma-gliadin or LMW glutenin | Glu-5 in Deamidated form | Immunogenic | Deamidated | DQ2 | 19 | 21 | QQLSQPELPQQQEL PQQPQQF |
| 379 | gamma-gliadin or LMW glutenin | Glu-5 in Deamidated form | Immunogenic | Deamidated | DQ2 | 19 | 21 | QQLSQPELPQQQEL PQQPQQF |
| 380 | gamma-gliadin or LMW glutenin | Glu-5 in Deamidated form | Immunogenic | Deamidated | DQ2 | 19 | 21 | QQLSQPQLPQEQEL PQQPQQF |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 381 | gamma-gliadin or LMW glutenin | Glu-5 in Deamidated form | Immunogenic | Deamidated | DQ2 | 19 | 21 | QELSQPELPQEQQL PQQPQQF |
| 382 | gamma-gliadin or LMW glutenin | Glu-5 in Deamidated form | Immunogenic | Deamidated | DQ2 | 19 | 21 | QELSQPELPQQQEL PQQPQQF |
| 383 | gamma-gliadin or LMW glutenin | Glu-5 in Deamidated form | Immunogenic | Deamidated | DQ2 | 19 | 21 | QELSQPQLPQEQEL PQQPQQF |
| 384 | gamma-gliadin or LMW glutenin | Glu-5 in Deamidated form | Immunogenic | Deamidated | DQ2 | 19 | 21 | QQLSQPELPQEQEL PQQPQQF |
| 385 | gamma-gliadin or LMW glutenin | Glu-5 in Deamidated form | Immunogenic | Deamidated | DQ2 | 19 | 21 | QELSQPELPQEQEL PQQPQQF |
| 386 | gamma-gliadin | gamma-gliadin P08079 | Immunogenic | Native | DQ8 | 54 | 20 | QQFLQPQQPFPQQP QQPYPQ |
| 387 | gamma-gliadin | gamma-gliadin P08079 | Immunogenic | Native | DQ8 | 54 | 17 | QQFLQPQQPFPQQP QQP |
| 388 | gamma-gliadin | gamma-5 gliadin (p59-p84) | Immunogenic | Native | DQ2 | 48 | 26 | FLQPQQPFPQQPQQ PYPQQPQQPFPQ |
| 389 | gamma-gliadin | gamma-5 gliadin (p59-p84; E63) | Immunogenic | Deamidated | DQ2 | 48 | 26 | FLQPEQPFPQQPQQ PYPQQPQQPFPQ |
| 390 | gamma-gliadin | gamma-5 gliadin (p59-p84; E68) | Immunogenic | Deamidated | DQ2 | 48 | 26 | FLQPQQPFPEQPQQ PYPQQPQQPFPQ |
| 391 | gamma-gliadin | gamma-5 gliadin (p59-p84; E71) | Immunogenic | Deamidated | DQ2 | 48 | 26 | FLQPQQPFPQQPEQ PYPQQPQQPFPQ |
| 392 | gamma-gliadin | gamma-5 gliadin (p59-p84; E76) | Immunogenic | Deamidated | DQ2 | 48 | 26 | FLQPQQPFPQQPQQ PYPEQPQQPFPQ |
| 393 | gamma-gliadin | gamma-5 gliadin (p59-p84; E79) | Immunogenic | Deamidated | DQ2 | 48 | 26 | FLQPQQPFPQQPQQ PYPQQPEQPFPQ |
| 394 | gamma-gliadin | gamma-5 gliadin (p59-p84; E63 and E68) | Immunogenic | Deamidated | DQ2 | 48 | 26 | FLQPEQPFPEQPQQ PYPQQPQQPFPQ |
| 395 | gamma-gliadin | gamma-5 gliadin (p59-p84; E63 and E71) | Immunogenic | Deamidated | DQ2 | 48 | 26 | FLQPEQPFPQQPEQ PYPQQPQQPFPQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 396 | gamma-gliadin | gamma-5 gliadin (p59-p84; E63 and E76) | Immunogenic | Deamidated | DQ2 | 48 | 26 | FLQPEQPFPQQPEQPQQ PYPEQPQQPFPQ |
| 397 | gamma-gliadin | gamma-5 gliadin (p59-p84; E63 and E79) | Immunogenic | Deamidated | DQ2 | 48 | 26 | FLQPEQPFPQQPEQPQQ PYPQQPEQPFPQ |
| 398 | gamma-gliadin | gamma-5 gliadin (p59-p84; E68 and E71) | Immunogenic | Deamidated | DQ2 | 48 | 26 | FLQPQQPFPEQPEQPQQ PYPQQPQQPFPQ |
| 399 | gamma-gliadin | gamma-5 gliadin (p59-p84; E68 and E76) | Immunogenic | Deamidated | DQ2 | 48 | 26 | FLQPQQPFPEQPQQPQQ PYPEQPQQPFPQ |
| 400 | gamma-gliadin | gamma-5 gliadin (p59-p84; E68 and E79) | Immunogenic | Deamidated | DQ2 | 48 | 26 | FLQPQQPFPEQPQQPQQ PYPQQPEQPFPQ |
| 401 | gamma-gliadin | gamma-5 gliadin (p59-p84; E71 and E76) | Immunogenic | Deamidated | DQ2 | 48 | 26 | FLQPQQPFPQQPEQPEQ PYPEQPQQPFPQ |
| 402 | gamma-gliadin | gamma-5 gliadin (p59-p84; E71 and E79) | Immunogenic | Deamidated | DQ2 | 48 | 26 | FLQPQQPFPQQPEQPEQ PYPQQPEQPFPQ |
| 403 | gamma-gliadin | gamma-5 gliadin (p59-p84; E76 and E79) | Immunogenic | Deamidated | DQ2 | 48 | 26 | FLQPQQPFPQQPEQPQQ PYPEQPEQPFPQ |
| 404 | gamma-gliadin | gamma-5 gliadin (p59-p84; E63, E68 and E71) | Immunogenic | Deamidated | DQ2 | 48 | 26 | FLQPEQPFPEQPEQPQQ PYPQQPQQPFPQ |
| 405 | gamma-gliadin | gamma-5 gliadin (p59-p84; E63, E68 and E76) | Immunogenic | Deamidated | DQ2 | 48 | 26 | FLQPEQPFPEQPQQPQQ PYPEQPQQPFPQ |
| 406 | gamma-gliadin | gamma-5 gliadin (p59-p84; E63, E68 and E79) | Immunogenic | Deamidated | DQ2 | 48 | 26 | FLQPEQPFPEQPQQPQQ PYPQQPEQPFPQ |
| 407 | gamma-gliadin | gamma-5 gliadin (p59-p84; E63, E71 and E76) | Immunogenic | Deamidated | DQ2 | 48 | 26 | FLQPEQPFPQQPEQPEQ PYPEQPQQPFPQ |
| 408 | gamma-gliadin | gamma-5 gliadin (p59-p84; E68, E71 and E79) | Immunogenic | Deamidated | DQ2 | 48 | 26 | FLQPQQPFPEQPEQPEQ PYPQQPEQPFPQ |
| 409 | gamma-gliadin | gamma-5 gliadin (p59-p84; E71, E76 and E79) | Immunogenic | Deamidated | DQ2 | 48 | 26 | FLQPQQPFPQQPEQPEQ PYPEQPEQPFPQ |
| 410 | gamma-gliadin | gamma-5 gliadin (p59-p84; E63, E68, E71, E76 and E79) | Immunogenic | Deamidated | DQ2 | 48 | 26 | FLQPEQPFPEQPEQPEQ PYPEQPEQPFPQ |
| 411 | gamma-gliadin | gamma-5 gliadin (p60-p79); DQ2-gamma-V gamma-Glia (p78-p97); gamma-3 and gamma-5 peptide 1317 | Immunogenic | Native | DQ2 | 57, 23, 48, 2 | 20 | LQQQPFPQQPQQP YPQQPQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 412 | gamma-gliadin | DQ2-gamma-V gamma-Glia (p78-p97; E81) | Immunogenic | Deamidated | DQ2 | 57, 23, 2 | 20 | LQPEQPFPQQPQQP YPQQPQ |
| 413 | gamma-gliadin | DQ2-gamma-V gamma-Glia (p78-p97; E86) | Immunogenic | Deamidated | DQ2 | 57, 23, 2 | 20 | LQPQQPFPEQPQQP YPQQPQ |
| 414 | gamma-gliadin | DQ2-gamma-V gamma-Glia (p78-p97; E89) | Immunogenic | Deamidated | DQ2 | 57, 23, 2 | 20 | LQPQQPFPQQPEQP YPQQPQ |
| 415 | gamma-gliadin | DQ2-gamma-V gamma-Glia (p78-p97; E94) | Immunogenic | Deamidated | DQ2 | 57, 23, 2 | 20 | LQPQQPFPQQPQQP YPEQPQ |
| 416 | gamma-gliadin | DQ2-gamma-V gamma-Glia (p78-p97; E81 and E86) | Immunogenic | Deamidated | DQ2 | 57, 23, 2 | 20 | LQPEQPFPEQPQQP YPQQPQ |
| 417 | gamma-gliadin | DQ2-gamma-V gamma-Glia (p78-p97; E81 and E89) | Immunogenic | Deamidated | DQ2 | 57, 23, 2 | 20 | LQPEQPFPQQPEQP YPQQPQ |
| 418 | gamma-gliadin | DQ2-gamma-V gamma-Glia (p78-p97; E81 and E94) | Immunogenic | Deamidated | DQ2 | 57, 23, 2 | 20 | LQPEQPFPQQPQQP YPEQPQ |
| 419 | gamma-gliadin | DQ2-gamma-V gamma-Glia (p78-p97; E86 and E89) | Immunogenic | Deamidated | DQ2 | 57, 23, 2 | 20 | LQPQQPFPEQPEQP YPQQPQ |
| 420 | gamma-gliadin | DQ2-gamma-V gamma-Glia (p78-p97; E86 and E64) | Immunogenic | Deamidated | DQ2 | 57, 23, 2 | 20 | LQPQQPFPEQPQQP YPEQPQ |
| 421 | gamma-gliadin | DQ2-gamma-V gamma-Glia (p78-p97; E89 and E94) | Immunogenic | Deamidated | DQ2 | 57, 23, 2 | 20 | LQPQQPFPQQPEQP YPEQPQ |
| 422 | gamma-gliadin | DQ2-gamma-V gamma-Glia (p78-p97; E81, E86 and E89) | Immunogenic | Deamidated | DQ2 | 57, 23, 2 | 20 | LQPEQPFPEQPEQP YPQQPQ |
| 423 | gamma-gliadin | DQ2-gamma-V gamma-Glia (p78-p97; E81, E86 and E94) | Immunogenic | Deamidated | DQ2 | 57, 23, 2 | 20 | LQPEQPFPEQPQQP YPEQPQ |
| 424 | gamma-gliadin | DQ2-gamma-V gamma-Glia (p78-p97; E86, E89 and E94) | Immunogenic | Deamidated | DQ2 | 57, 23, 2 | 20 | LQPQQPFPEQPEQP YPEQPQ |
| 425 | gamma-gliadin | DQ2-gamma-V gamma-Glia (p78-p97; E81, E86, E89 and E94) | Immunogenic | Deamidated | DQ2 | 57, 23, 2 | 20 | LQPEQPFPEQPEQP YPEQPQ |
| 426 | gamma-gliadin | gamma3/gamma4 | Immunogenic | Native | DQ2 | 25 | 17 | PQQPFPQQPQQPYP QQP |
| 427 | gamma-gliadin | gamma5 (p62-p74) | Immunogenic | Native | DQ2 | 25 | 13 | PQQPFPQQPQQPY |
| 428 | gamma-gliadin | gamma5 (p62-p74; E68) | Immunogenic | Deamidated | DQ2 | 25 | 13 | PQQPFPEQPQQPY |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 429 | gamma-gliadin | gamma5 (p62-p74; E63 and E68) | Immunogenic | Deamidated | DQ2 | 25 | 13 | PEQPFPEQPEQPY |
| 430 | gamma-gliadin | gamma5 (p62-p74; E68 and E71) | Immunogenic | Deamidated | DQ2 | 25 | 13 | PQQPFPEQPEQPY |
| 431 | gamma-gliadin | gamma5 (p62-p74; E63, E68 and E71) | Immunogenic | Deamidated | DQ2 | 25 | 13 | PEQPFPEQPEQPY |
| 432 | gamma-gliadin | gamma-5 gliadin (p62-p72) | Immunogenic | Native | DQ2 | 47, 48 | 11 | PQQPFPQQPQQ |
| 433 | gamma-gliadin | gamma5-gliadin (p62-p72; E68) | Immunogenic | Deamidated | DQ2 | 47 | 11 | PQQPFPEQPQQ |
| 434 | gamma-gliadin | gamma5 (p62-p72; E68, E63 and E71) | Immunogenic | Deamidated | DQ2 | 25 | 11 | PEQPFPEQPEQ |
| 435 | gamma-gliadin | gamma23mer | Immunogenic | Native | DQ2 | 61 | 23 | QQPFPQQPQQPYPQQPQQPFPQP |
| 436 | gamma-gliadin | gamma23mer (in considered Deamidated form) | Immunogenic | Deamidated | DQ2.5 | 61 | 23 | EQPFPEQPEQPYPEQPEQPFPQP |
| 437 | gamma-gliadin | gamma5-gliadin (p60-p79) | Immunogenic | Native | DQ2 | 21 | 14 | QQPFPEQPQQPYPQ |
| 438 | gamma-5 gliadin | DQ2.5_glia_gamma5 | Immunogenic | Native | DQ2.5 | 25, 90, 23 | 9 | QQPFPQQPQ |
| 439 | gamma-5 gliadin | DQ2.5_glia_gamma5 | Immunogenic | Deamidated | DQ2.5 | 25, 90, 23 | 9 | QQPFPEQPQ |
| 440 | gamma-gliadin | CAUTION 100% match to Archaea protein lower to others and to gamma5 (p63-p71; E63, E68 and E71) | Immunogenic | Deamidated | DQ2 | 25 | 9 | EQPFPEQPE |
| 441 | gamma-gliadin | DQ2-gamma-Ill gamma-Glia (p83-p97) | Immunogenic | Native | DQ2 | 2 57, 48, 23, | 15 | PFPQQPQQPYPQQPQ |
| 442 | gamma-gliadin | DQ2-gamma-Ill gamma-Glia (p83-p97; E86) | Immunogenic | Deamidated | DQ2 | 2 57, 48, 23, | 15 | PFPEQPQQPYPQQPQ |
| 443 | gamma-gliadin | DQ2-gamma-Ill gamma-Glia (p83-p97; E89) | Immunogenic | Deamidated | DQ2 | 2 57, 48, 23, | 15 | PFPQQPEQPYPQQPQ |
| 444 | gamma-gliadin | DQ2-gamma-Ill gamma-Glia (p83-p97; E86 and E89) | Immunogenic | Deamidated | DQ2 | 2 57, 48, 23, | 15 | PFPEQPEQPYPQQPQ |
| 445 | gamma-gliadin | Wheat peptide W23 | Immunogenic | Native | DQ2 | 2 62 | 12 | PFPQQPQQPYPQ |
| 446 | gamma-gliadin | gamma-gliadin (p66-p80) AJ416339 | Immunogenic | Native | DQ8, DQ2 | 17 | 15 | FPQQPQQPYPQQPQQ |
| 447 | gamma-gliadin | gamma-gliadin (p66-p80; E68) AJ416339 | Immunogenic | Deamidated | DQ8 | 17, 83 | 15 | FPEQPQQPYPQQPQQ |
| 448 | gamma-gliadin | gamma-gliadin (p66-p80; E71) AJ416339 | Immunogenic | Deamidated | DQ2 | 17 | 15 | FPQQPEQPYPQQPQQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 449 | gamma-gliadin | gamma-gliadin (p66-p80; E76) AJ416339 | Immunogenic | Deamidated | DQ8, DQ2 | 17 | 15 | FPQQPQQPYPEQPQQ |
| 450 | gamma-gliadin | gamma-gliadin (p66-p80; E71 and 76) AJ416339 | Immunogenic | Deamidated | DQ8 | 17 | 15 | FPEQPQQPYPEQPQQ |
| 451 | gamma-gliadin | gamma5 (p66-p78) | Immunogenic | Native | DQ2 | 23 | 13 | FPQQPQQPYPQQP |
| 452 | gamma-gliadin | gamma5 (p66-p78; E68 and E71) | Immunogenic | Deamidated | DQ2 | 23 | 13 | FPEQPEQPYPQQP |
| 453 | gamma-gliadin | gamma5 (p66-p78; E68 and E72) | Immunogenic | Deamidated | DQ2 | 23 | 13 | FPEQPQEPYPQQP |
| 454 | gamma-gliadin | gamma5 (p66-p77) | Immunogenic | Native | DQ2 | 25 | 12 | FPQQPQQPYPQQ |
| 455 | gamma-gliadin | gamma5 (p66-p77; E71) | Immunogenic | Deamidated | DQ2 | 25 | 12 | FPQQPEQPYPQQ |
| 456 | gamma-gliadin | gamma5 (p66-p77; E68, E71 and E76) | Immunogenic | Deamidated | DQ2 | 25 | 12 | FPEQPEQPYPEQ |
| 457 | gamma-gliadin | gamma5 (p67-p77; E68, E71 and E76) | Immunogenic | Deamidated | DQ2 | 25 | 11 | PEQPEQPYPEQ |
| 458 | gamma-1 and gamma5 gliadin | CAUTION 100% matches to many fungal and parasite proteins as well as DQ2.5_glia_gamma3 DQ8_glia_gamma 1b | Immunogenic | Native | DQ2.5/DQ8 | 17, 23, 78 | 9 | QQPQQPYPQ |
| 459 | gamma-5 gliadinDQ8_glia_gamma1b | DQ2.5_glia_gamma1b | Immunogenic | Deamidated | DQ2.5/DQ8 | 25, 17, 78 | 9 | EQPEQPYPE |
| 460 | gamma-1 gliadinDQ8_glia_gamma 1b | | Immunogenic | Deamidated | DQ2.5/DQ8 | 25, 17, 78 | 9 | EQPQQPYPE |
| 461 | gamma-1 gliadinDQ8_glia_gamma 1b | | Immunogenic | Deamidated | DQ2.5/DQ8 | 25, 17, 78 | 9 | EQPQQPFPE |
| 462 | gamma-III gliadin | CAUTION 100% identity matches to fungal and lower to other fungal proteins as DQ2.5_glia_gamma3 DQ8_glia_gamma1b | Immunogenic | Deamidated | DQ2.5/DQ8 | 17, 78 | 9 | QQPEQPYPQ |
| 463 | gamma-gliadin | Predicted gamma-gliadin peptide | Immunogenic | Native | DQ8 (DQ2/8) | 22 | 14 | QQPYPQQPQQPFPQ |
| 464 | gamma-gliadin | CAUTION many 100% identity matches to legume and bacterial proteins and also gamma-Vib gliadin | Immunogenic | Native | DQ2 | 25 | 9 | QQPYPQQPQ |
| 465 | gamma-gliadin | CAUTION 100% match to bacterial protein and lower to others and gamma-Vib gliadin in Deamidated form | Immunogenic | Deamidated | DQ2 | 25 | 9 | EQPYPQQPQ |
| 466 | gamma-gliadin | CAUTION 100% identity to bacterial protein and lower to others and gamma-Vib gliadin in Deamidated form | Immunogenic | Deamidated | DQ2 | 25 | 9 | QQPYPEQPQ |
| 467 | gamma-gliadin | gamma-Vib gliadin in Deamidated form | Immunogenic | Deamidated | DQ2 | 25 | 9 | EQPYPEQPQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 468 | gamma-gliadin | CAUTION many 100% matches to fish, fungi and other non-wheat family proteins also a few to Secalin Glia-gamma2 | Immunogenic | Native | DQ2 (DQ2.2 and DQ2.5) | 44 | 9 | PYPQQPQQP |
| 469 | gamma-gliadin | Glia-gamma2 in Deamidated form | Immunogenic | Deamidated | DQ2 (DQ2.2 and DQ2.5) | 44, 83 | 9 | PYPEQPQQP |
| 470 | gamma-gliadin | Glia-gamma2 in Deamidated form | Immunogenic | Deamidated | DQ2 (DQ2.2 and DQ2.5) | 44 | 9 | PYPQQPEQP |
| 471 | gamma-gliadin | CAUTION 100% match to bacterial protein and lizard protein lower to grapes and wheat Glia-gamma2 in Deamidated form | Immunogenic | Deamidated | DQ2 (DQ2.2 and DQ2.5) | 44 | 9 | PYPEQPEQP |
| 472 | gamma-gliadin | CAUTION 100% 4 matches to Candida 2 to bacteria and many to secalins and wheat gamma2-gliadin | Immunogenic | Native | DQ2.5/DQ8 | 90, 8 | 9 | QQPQQPFPQ |
| 473 | gamma-2 gliadin | CAUTION 100% match to fungal protein and lower to Candida and to Gliadin epitope: gamma-1 | Immunogenic | Deamidated | DQ2.5/DQ8 | 90, 17, 8 | 9 | EQPQQPFPQ |
| 474 | gamma-2 gliadin | Gliadin epitope: gamma-VII | Immunogenic | Deamidated | DQ2.5/DQ8 | 90, 17, 8 | 9 | QQPEQPFPQ |
| 475 | gamma-2 gliadin | CAUTION 100% match to a bacterial protein/lower to triticum gammaVII-gliadin in Deamidated form | Immunogenic | Deamidated | DQ2.5/DQ8 | 25, 90, 17 | 9 | EQPEQPFPQ |
| 476 | gamma-gliadin | gamma-Glia (p105-p118) | Immunogenic | Native | DQ2 | 57 | 14 | PQQTLQPQQPAQL |
| 477 | gamma-gliadin | gamma-Glia (p105-p118; E113) | Immunogenic | Native | DQ2 | 57 | 14 | PQQQTLQPEQPAQL |
| 478 | gamma-gliadin | Wheat peptide W37 | Immunogenic | Native | DQ2 | 62 | 20 | ATANMQVDPSGQVQWPQQQP |
| 479 | gamma-gliadin | Wheat peptide W37 | Immunogenic | Native | DQ2 | 62 | 12 | QVDPSGQVQWPQ |
| 480 | gamma-gliadin | gamma-gliadin 1370 (p1-p30); gamma-gliadin M2 M36999 (p11-p30) homologous to DQ2-alpha-I | Immunogenic | Native | DQ2, DQ8 | 17, 23 | 20 | WPQQQPFPQPQQPFCQQPQR |
| 481 | gamma-gliadin | gamma-gliadin 1371 (p21-p40) | Immunogenic | Native | DQ2 | 17 | 20 | QQPFCQQPQRTIPQPHQTFH |
| 482 | gamma-gliadin | gamma-gliadin 1372 (p31-p50) | Immunogenic | Native | DQ2 | 17 | 20 | TIPQPHQTFHHQPQQTFPQP |
| 483 | gamma-gliadin | gamma-gliadin 1372 (p41-p60) | Immunogenic | Native | DQ2, DQ8 | 17 | 20 | HQPQQTFPQQQTYPHQPQQ |
| 484 | gamma1-gliadin | gamma-gliadin 1372 (p51-p70) | Immunogenic | Native | DQ2 | 17 | 20 | QQTYPHQPQQQFPQTQQPQQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 485 | gamma1-gliadin | gamma-gliadin 1375 (p61-p80); gamma-gliadin M7 M36999 (p61-p80) homologous to DQ2-gamma-III | Immunogenic | Native | DQ2, DQ8 | 25, 17, 23 | 20 | QFPQTQQPQQPFFPQPQQTFP |
| 486 | gamma1-gliadin | gamma-gliadin 1375 (p61-p80; E64); gamma-gliadin M7 M36999 (p61-p80) homologous to DQ2-gamma-III | Immunogenic | Deamidated | DQ2 | 25 | 20 | QFPETQQPQQPFFPQPQQTFP |
| 487 | gamma1-gliadin | gamma-gliadin 1375 (p61-p80; E66); gamma-gliadin M7 M36999 (p61-p80) homologous to DQ2-gamma-III | Immunogenic | Deamidated | DQ2 | 25 | 20 | QFPQTEQPQQPFFPQPQQTFP |
| 488 | gamma1-gliadin | gamma-gliadin 1375 (p61-p80; E69); gamma-gliadin M7 M36999 (p61-p80) homologous to DQ2-gamma-III | Immunogenic | Deamidated | DQ2 | 25 | 20 | QFPQTQQPEQPFFPQPQQTFP |
| 489 | gamma1-gliadin | gamma-gliadin 1375 (p61-p80; E76); gamma-gliadin M7 M36999 (p61-p80) homologous to DQ2-gamma-III | Immunogenic | Deamidated | DQ2 | 25 | 20 | QFPQTQQPQQPFFPQPEQTFP |
| 490 | gamma1-gliadin | gamma-gliadin 1375 (p61-p80; E64 and E66); gamma-gliadin M7 M36999 (p61-p80) homologous to DQ2-gamma-III | Immunogenic | Deamidated | DQ2 | 25 | 20 | QFPETEQPQQPFFPQPQQTFP |
| 491 | gamma1-gliadin | gamma-gliadin 1375 (p61-p80; E64 and E69); gamma-gliadin M7 M36999 (p61-p80) homologous to DQ2-gamma-III | Immunogenic | Deamidated | DQ2 | 25 | 20 | QFPETQQPEQPFFPQPQQTFP |
| 492 | gamma1-gliadin | gamma-gliadin 1375 (p61-p80; E64 and E76); gamma-gliadin M7 M36999 (p61-p80) homologous to DQ2-gamma-III | Immunogenic | Deamidated | DQ2 | 25 | 20 | QFPETQQPQQPFFPQPEQTFP |
| 493 | gamma1-gliadin | gamma-gliadin 1375 (p61-p80; E66 and E69); gamma-gliadin M7 M36999 (p61-p80) homologous to DQ2-gamma-III | Immunogenic | Deamidated | DQ2 | 25 | 20 | QFPQTEQPEQPFFPQPQQTFP |
| 494 | gamma1-gliadin | gamma-gliadin 1375 (p61-p80; E66 and E76); gamma-gliadin M7 M36999 (p61-p80) homologous to DQ2-gamma-III | Immunogenic | Deamidated | DQ2 | 25 | 20 | QFPQTEQPQQPFFPQPEQTFP |
| 495 | gamma1-gliadin | gamma-gliadin 1375 (p61-p80; E69 and E76); gamma-gliadin M7 M36999 (p61-p80) homologous to DQ2-gamma-III | Immunogenic | Deamidated | DQ2 | 25 | 20 | QFPQTQQPEQPFFPQPEQTFP |
| 496 | gamma1-gliadin | gamma-gliadin 1375 (p61-p80; E64, E66, E69); gamma-gliadin M7 M36999 (p61-p80) homologous to DQ2-gamma-III | Immunogenic | Deamidated | DQ2 | 25 | 20 | QFPETEQPEQPFFPQPQQTFP |
| 497 | gamma1-gliadin | gamma-gliadin 1375 (p61-p80; E64, E66, E76); gamma-gliadin M7 M36999 (p61-p80) homologous to DQ2-gamma-III | Immunogenic | Deamidated | DQ2 | 25 | 20 | QFPETEQPQQPFFPQPEQTFP |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 498 | gamma1-gliadin | gamma-gliadin 1375 (p61-p80; E64, E69 and E76); gamma-gliadin M7 M36999 (p61-p80) homologous to DQ2-gamma-III | Immunogenic | Deamidated | DQ2 | 25 | 20 | QFPETQQPEQPFPQPEQTFP |
| 499 | gamma1-gliadin | gamma-gliadin 1375 (p61-p80; E66, E69 and E76); gamma-gliadin M7 M36999 (p61-p80) homologous to DQ2-gamma-III | Immunogenic | Deamidated | DQ2 | 25 | 20 | QFPQTEQPEQPFPQPEQTFP |
| 500 | gamma1-gliadin | gamma-gliadin 1375 (p61-p80; E64, E66, E69 and E76); gamma-gliadin M7 M36999 (p61-p80) homologous to DQ2-gamma-III | Immunogenic | Deamidated | DQ2 | 25 | 20 | QFPETEQPEQPFPQPEQTFP |
| 501 | gamma1-gliadin | Wheat peptide W28, W33 | Immunogenic | Native | DQ2 | 62 | 20 | PQQPFPQPQQTFPQQPQLPF |
| 502 | gamma1-gliadin | gamma-gliadin 1376 (p71-p90); gamma-gliadin M8 M36999 (71-80) homologous to DQ2-alpha-I and DQ2-gamma-IV | Immunogenic | Native | DQ2, DQ8 | 17, 23 | 20 | PFPQPQQTFPQQPQLPFPQQ |
| 503 | gamma1-gliadin | Wheat peptide W33 | Immunogenic | Native | DQ2 | 62 | 11 | PFPQPQQTFPQ |
| 504 | gamma1-gliadin | Wheat peptide W28 | Immunogenic | Native | DQ2 | 62 | 12 | PQQTFPQQPQLP |
| 505 | gamma1-gliadin | Wheat peptide W10 | Immunogenic | Native | DQ2 | 62 | 20 | SQQPQQQFSQPQQQFPQPQQ |
| 506 | gamma1-gliadin | DQ2-y-IV y-Glia (p117-p132) | Immunogenic | Native | DQ2 | 57, 23 | 15 | QQFSQPQQQFPQPQQ |
| 507 | gamma1-gliadin | DQ2-y-IV y-Glia (p117-p132; E123) | Immunogenic | Deamidated | DQ2 | 57, 23 | 15 | QQFSQPEQQFPQPQQ |
| 508 | gamma1-gliadin | DQ2-y-IV y-Glia (p117-p132; E125) | Immunogenic | Deamidated | DQ2 | 57, 23 | 15 | QQFSQPQQEFPQPQQ |
| 509 | gamma1-gliadin | DQ2-y-IV y-Glia (p117-p132; E123 and E125) | Immunogenic | Deamidated | DQ2 | 57, 23 | 15 | QQFSQPEQEFPQPQQ |
| 510 | gamma1-gliadin | Wheat peptide W10 | Immunogenic | Native | DQ2 | 62 | 12 | QQFSQPQQFPQ |
| 511 | gamma1-gliadin | gamma-IV (p101-p113) | Immunogenic | Native | DQ2 | 23 | 13 | QFSQPQQQFPQPQ |
| 512 | gamma1-gliadin | gamma-gliadin (gammas p102-p113) | Immunogenic | Deamidated | DQ2 | 23 | 12 | FSQPQQQFPQPQ |
| 513 | gamma1-gliadin | gamma5 (p102-p113; E106) | Immunogenic | Deamidated | DQ2 | 23 | 12 | FSQPEQQFPQPQ |
| 514 | gamma1-gliadin | gamma5 (p102-p113; E108) | Immunogenic | Deamidated | DQ2 | 23 | 12 | FSQPQQEFPQPQ |
| 515 | gamma1-gliadin | gamma5 (p102-p113; E106 and E108) | Immunogenic | Deamidated | DQ2 | 25, 23 | 12 | FSQPEQEFPQPQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 516 | gamma1-gliadin | gamma-gliadin gamma5 (p102-p111) | Immunogenic | Native | DQ2 | 25 | 10 | FSQPQQQFPQ |
| 517 | gamma1-gliadin | gamma-gliadin gamma5 (p102-p111; E106) | Immunogenic | Deamidated | DQ2 | 25 | 10 | FSQPEQQFPQ |
| 518 | gamma1-gliadin | gamma-gliadin gamma5 (p102-p111; E108) | Immunogenic | Deamidated | DQ2 | 25 | 10 | FSQPQQEFPQ |
| 519 | gamma1-gliadin | gamma-gliadin gamma5 (p102-p111; E106 and E108) | Immunogenic | Deamidated | DQ2 | 25 | 10 | FSQPEQEFPQ |
| 520 | gamma1-gliadin | gamma-gliadin gamma5-IV (p103-p114) | Immunogenic | Native | DQ2 | 23 | 12 | SQPQQQFPQQQQ |
| 521 | gamma-5 gliadin | inCAUTION 100% match to fungal protein and many wheat proteins glia-gamma 4a | Immunogenic | Native | DQ2.5 | 90, 25, 23 | 9 | SQPQQQFPQ |
| 522 | gamma-5 gliadin | glia-gamma 4a | Immunogenic | Deamidated | DQ2.5 | 90, 25, 23 | 9 | SQPEQEFPQ |
| 523 | gamma1-gliadin | gamma-gliadin of GDB2_WHEAT (SwissProt P08453 GI:121101) (p140-p150) | Immunogenic | Native | DQ2 | 24 | 11 | QQPQQSFPQQQ |
| 524 | gamma1-gliadin | gamma-gliadin of GDB2_WHEAT (SwissProt P08453 GI170738) (p141-p150) | Immunogenic | Native | DQ2 | 24 | 10 | QPQQSFPQQQ |
| 525 | gamma1-gliadin | gamma-gliadin of GDB2_WHEAT (SwissProt P08453 GI170738) (p141-p150; E148) | Immunogenic | Deamidated | DQ2 | 24 | 10 | QPQQSFPEQQ |
| 526 | gamma-gliadin | Wheat peptide W07 | Immunogenic | Native | DQ2 | 62 | 20 | WPQQQPFPQPQQPFCQQPQQ |
| 527 | gamma-gliadin | Wheat peptide W07 | Immunogenic | Deamidated | DQ2 | 62 | 20 | WPQQQPFPQPEQPFCQQPQQ |
| 529 | gamma-gliadin | Wheat peptide W07 | Immunogenic | Deamidated | DQ2 | 62 | 12 | QPFPQPEQPFCQ |
| 530 | gamma-gliadin | Predicted gamma-gliadin | Immunogenic | Native | DQ8 (DQ2/8) | 22 | 14 | QFPQTQQPQQPFPQ |
| 531 | gamma-gliadin | gamma-gliadin M36999 (p63-p76; E66) | Immunogenic | Synthesised as Deamidated | DQ8 | 17 | 14 | PQTEQPQQPFPQPQ |
| 532 | gamma-gliadin | gamma-gliadin M36999 (p63-p76; E69) | Immunogenic | Synthesised as Deamidated | DQ2 | 17 | 14 | PQTQQPEQPFPQPQ |
| 533 | gamma-gliadin | gamma-gliadin M36999 (p63-p76; E66 and E69) | Immunogenic | Synthesised as Deamidated | DQ2, DQ8 | 17 | 14 | PQTEQPEQPFPQPQ |
| 534 | gamma-gliadin | gamma-gliadin 1375 (p61-p80); gamma-gliadin M7 M36999 (61-80) homologous to DQ2-gamma-III | Immunogenic | Native | DQ2 | 25 | 11 | TQQPQQPFPQP |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 535 | gamma-gliadin | gamma-gliadin 1375 (p61-p80; E62 and E65),; gamma-gliadin M7 M36999 (61-80) homologous to DQ2-gamma-III | Immunogenic | Deamidated | DQ2 | 25 | 11 | TEQPEQPFFQP |
| 536 | gamma-gliadin | gamma-gliadin 1377 (p81-p100) | Immunogenic | Native | DQ2, DQ8 | 17 | 20 | QQPQLPFPQQPQQP FPQPQQ |
| 537 | gamma-gliadin | gamma-gliadin (p84-p97) | Immunogenic | Native | DQ8 (DQ2/8) | 22 | 14 | QLPFPQQPQQPFFPQ |
| 538 | gamma-gliadin | Glia-gamma2 (p89-p102) | Immunogenic | Native | DQ2 | 20 | 10 | PFFQQPQQPF |
| 539 | gamma-gliadin | Glia-gamma2 (p89-p102; E92) | Immunogenic | Deamidated | DQ2 | 20 | 10 | PFFEQPQQPF |
| 540 | gamma-gliadin | Glia-gamma2 (p89-p102; E94) | Immunogenic | Deamidated | DQ2 | 20 | 10 | PFFQQPEQPF |
| 541 | gamma-gliadin | Glia-gamma2 (p89-p102; E92 and E94) | Immunogenic | Deamidated | DQ2 | 20 | 10 | PFFEQPEQPF |
| 542 | gamma-gliadin | CAUTION 100% match to a fungal protein and many Secalins gamma-Gliadin (p90-p102) | Immunogenic | Native | DQ2 | 27 | 9 | FPQQPQQPF |
| 543 | gamma-gliadin | gamma-Gliadin (p90-p102; E92) | Immunogenic | Deamidated | DQ2 | 27 | 9 | FPQQPEQPF |
| 544 | gamma-gliadin | gamma-Gliadin (p90-p102; E96) | Immunogenic | Deamidated | DQ2 | 27 | 9 | FPQQPQEPF |
| 545 | gamma-gliadin | gamma-Gliadin (p90-p102; E92 and E96) | Immunogenic | Deamidated | DQ2 | 27 | 9 | FPEQPQEPF |
| 546 | gamma-gliadin | gamma-gliadin 1378 (p91-p110),; gamma-gliadin M10 M36999 (91-110) homologous to DQ2-alpha-I | Immunogenic | Native | DQ2, DQ8 | 17, 23 | 20 | PQQPFPQPQPQQP FPQSQQ |
| 547 | gamma-gliadin | Wheat peptide W36 | Immunogenic | Native | DQ2 | 62 | 20 | QQPAQYEVIRSLVL RTLPNM |
| 548 | gamma-gliadin | Wheat peptide W36 | Immunogenic | Native | DQ2 | 62 | 16 | QYEVIRSLVLRTLP NM |
| 549 | gamma-gliadin | Wheat peptide W36 | Immunogenic | Deamidated | DQ2 | 62 | 15 | EYEVIRSLVLRTLP N |
| 550 | gamma-gliadin | Wheat peptide W36 | Immunogenic | Native | DQ2 | 62 | 15 | QYQVIRSLVLRTLP N |
| 551 | gamma-gliadin | gamma-gliadin AAK84778 (p74-p93) | Immunogenic | Native | DQ8 | 54 | 20 | QQQPFIQPQPFFPQQ PQQTYP |
| 552 | gamma-gliadin | Wheat peptide W14 | Immunogenic | Native | DQ2 | 62 | 12 | QQFIQPQQPFFQ |
| 553 | gamma-gliadin | Predicted gamma-gliadin | Immunogenic | Native | DQ8 (DQ2/8) | 22 | 14 | PFPQTQQPQQPFFQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 554 | gamma-gliadin | gamma-gliadin 1379 (p101-p120) | Immunogenic | Native | DQ2, DQ8 | 17 | 20 | PQQPFPQSQQPQQP FPQPQQ |
| 555 | gamma-gliadin | Predicted gamma-gliadin | Immunogenic | Native | DQ8 (DQ2/8) | 22 | 14 | PFPQSQQPQQPFPQ |
| 556 | gamma-gliadin | Wheat peptide W16 | Immunogenic | Native | DQ2 | 62 | 20 | SQQPQQPFPQPQQ FPQPQQ |
| 557 | gamma-gliadin | gamma-gliadin 1380 (p111-p130); gamma-gliadin M12 M36999 (111-130) homologous to DQ2-gamma-IV | Immunogenic | Native | DQ2 | 25, 17, 23 | 20 | PQQPFPQPQQQFPQ PQQPQQ |
| 558 | gamma-gliadin | gamma-gliadin 1380 (p111-p130; E112); gamma-gliadin M12 M36999 (111-130) homologous to DQ2-gamma-IV | Immunogenic | Deamidated | DQ2 | 25 | 20 | PEQPFPQPQQQFPQ PQQPQQ |
| 559 | gamma-gliadin | gamma-gliadin 1380 (p111-p130; E119); gamma-gliadin M12 M36999 (111-130) homologous to DQ2-gamma-IV | Immunogenic | Deamidated | DQ2 | 25 | 20 | PQQPFPQPQQQFPQ PEQPQQ |
| 560 | gamma-gliadin | gamma-gliadin 1380 (p111-p130; E121); gamma-gliadin M12 M36999 (111-130) homologous to DQ2-gamma-IV | Immunogenic | Deamidated | DQ2 | 25 | 20 | PQQPFPQPQQQFPQ PQQPEQ |
| 561 | gamma-gliadin | gamma-gliadin 1380 (p111-p130; E126); gamma-gliadin M12 M36999 (111-130) homologous to DQ2-gamma-IV | Immunogenic | Deamidated | DQ2 | 25 | 20 | PQQPFPQPQQEFPQ PQQPQQ |
| 562 | gamma-gliadin | gamma-gliadin 1380 (p111-p130; E112 and E119); gamma-gliadin M12 M36999 (111-130) homologous to DQ2-gamma-IV | Immunogenic | Deamidated | DQ2 | 25 | 20 | PEQPFPQPQQQFPQ PEQPQQ |
| 563 | gamma-gliadin | gamma-gliadin 1380 (p111-p130; E112 and E121); gamma-gliadin M12 M36999 (111-130) homologous to DQ2-gamma-IV | Immunogenic | Deamidated | DQ2 | 25 | 20 | PEQPFPQPQQQFPQ PEQPQQ |
| 564 | gamma-gliadin | gamma-gliadin 1380 (p111-p130; E112 and E126); gamma-gliadin M12 M36999 (111-130) homologous to DQ2-gamma-IV | Immunogenic | Deamidated | DQ2 | 25 | 20 | PEQPFPQPQQEFPQ PQQPQQ |
| 565 | gamma-gliadin | gamma-gliadin 1380 (p111-p130; E119 and E121); gamma-gliadin M12 M36999 (111-130) homologous to DQ2-gamma-IV | Immunogenic | Deamidated | DQ2 | 25 | 20 | PQQPFPQPQQQFPQ PEQPQQ |
| 566 | gamma-gliadin | gamma-gliadin 1380 (p111-p130; E119 and E126); gamma-gliadin M12 M36999 (111-130) homologous to DQ2-gamma-IV | Immunogenic | Deamidated | DQ2 | 25 | 20 | PQQPFPQPQQEFPQ PEQPQQ |
| 567 | gamma-gliadin | gamma-gliadin 1380 (p111-p130; E121 and E126); gamma-gliadin M12 M36999 (111-130) homologous to DQ2-gamma-IV | Immunogenic | Deamidated | DQ2 | 25 | 20 | PQQPFPQPQQEFPQ PEQPQQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 568 | gamma-gliadin | gamma-gliadin 1380 (p111-p130; E112, E119 and E121); gamma-gliadin M12 M36999 (111-130) homologous to DQ2-gamma-IV | Immunogenic | Deamidated | DQ2 | 25 | 20 | PEQPFPQPEQEFPQPQQPQQ |
| 569 | gamma-gliadin | gamma-gliadin 1380 (p111-p130; E112, E119 and E126); gamma-gliadin M12 M36999 (111-130) homologous to DQ2-gamma-IV | Immunogenic | Deamidated | DQ2 | 25 | 20 | PEQPFPQPQQFPQPEQPQ |
| 570 | gamma-gliadin | gamma-gliadin 1380 (p111-p130; E112, E121 and E126); gamma-gliadin M12 M36999 (111-130) homologous to DQ2-gamma-IV | Immunogenic | Deamidated | DQ2 | 25 | 20 | PEQPFPQQPQEFPQPEQPQ |
| 571 | gamma-gliadin | gamma-gliadin 1380 (p111-p130; E112, E121 and E126); gamma-gliadin M12 M36999 (111-130) homologous to DQ2-gamma-IV | Immunogenic | Deamidated | DQ2 | 25 | 20 | PQQPFPQPEQEFPQPEQPQ |
| 572 | gamma-gliadin | gamma-gliadin 1380 (p111-p130; E112, E119, E121 and E126); gamma-gliadin M12 M36999 (111-130) homologous to DQ2-gamma-IV | Immunogenic | Deamidated | DQ2 | 25 | 20 | PEQPFPQPEQEFPQPEQPQ |
| 573 | gamma-gliadin | gamma-gliadin 1380 (p111-p130; E112, E115); gamma-gliadin M12 M36999 (111-130) homologous to DQ2-gamma-IV; W16 | Immunogenic | Native | DQ2 | 62, 25 | 12 | FPQQQQFPQPQ |
| 574 | gamma-gliadin | gamma-gliadin 1380 (p111-p130; E115); gamma-gliadin M12 M36999 (111-130) homologous to DQ2-gamma-IV | Immunogenic | Deamidated | DQ2 | 25 | 12 | FPQPEQQFPQPQ |
| 575 | gamma-gliadin | gamma-gliadin 1380 (p111-p130; E117); gamma-gliadin M12 M36999 (111-130) homologous to DQ2-gamma-IV | Immunogenic | Deamidated | DQ2 | 25 | 12 | FPQPQQEFPQPQ |
| 576 | gamma-gliadin | gamma-gliadin 1380 (p111-p130; E115 and E117); gamma-gliadin M12 M36999 (111-130) homologous to DQ2-gamma-IV | Immunogenic | Deamidated | DQ2 | 25 | 12 | FPQPEQEFPQPQ |
| 577 | gamma-gliadin | CAUTION 100% matches to 3 fungal and metazoan proteins and wheat glia-gamma 4b | Immunogenic | Native | DQ2.5 | 90, 25 | 9 | PQPQQQFPQ |
| 578 | gamma-gliadin | glia-gamma 4b | Immunogenic | Deamidated | DQ2.5 | 90, 25 | 9 | PQPQQQFPQ |
| 579 | gamma-gliadin | glia gamma 4b | Immunogenic | Deamidated | DQ2.5 | 90, 25 | 9 | PQPQQEFPQ |
| 580 | gamma-gliadin | glia-gamma 4b | Immunogenic | Deamidated | DQ2.5 | 90, 25 | 9 | PQPQEFPQ |
| 581 | gamma-gliadin | Wheat peptide W16 | Immunogenic | Deamidated | DQ2 | 62 | 16 | GQQPFPQPEQEFPQPG |
| 582 | gamma-gliadin | Wheat peptide W16 | Immunogenic | Deamidated | DQ2 | 62 | 13 | QPFPQPEQEFPQP |
| 583 | gamma-1 gliadin | glia-alpha 1, glia-gamma 1 | Immunogenic | Native | DQ2.5/DQ8 | 8, 74, 76, 24 | 9 | PQQSFPQQQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 584 | gamma-gliadin | glia-alpha1, glia-gamma1 | Immunogenic | Deamidated | DQ2.5/DQ8 | 8, 74, 76, 24 | 9 | PQQSFPQQE |
| 585 | gamma-1 gliadin | glia-alpha 1, glia-gamma 1 | Immunogenic | Deamidated | DQ2.5/DQ8 | 8, 76, 24 | 9 | PQQSFPEQE |
| 586 | gamma-1 gliadin | glia-alpha1, glia-gamma1 | Immunogenic | Deamidated | DQ2.5, DQ8 | 8, 17, 76, 24 | 9 | PQQSFPEQQ |
| 587 | gamma-gliadin | Glia-gamma30-gliadin (p222-p236) | Immunogenic | Native | DQ2 | 19 | 15 | VQGQGIIQPQQPAQL |
| 588 | gamma-gliadin | Glia-gamma30-gliadin (p222-236; E225) | Immunogenic | Deamidated | DQ2 | 19 | 15 | VQGEGIIQPQQPAQL |
| 589 | gamma-gliadin | Glia-gamma30-gliadin (p222-236; E231) | Immunogenic | Deamidated | DQ2 | 19 | 15 | VQGQGIIQPEQPAQL |
| 590 | gamma-gliadin | Glia-gamma30-gliadin (p222-236; E225 and E231) | Immunogenic | Deamidated | DQ2 | 19 | 15 | VQGEGIIQPEQPAQL |
| 591 | gamma-gliadin | DQ2-y -II y-Glia (p222-p236) | Immunogenic | Native | DQ2 | 57 | 15 | GQGIIQPQQPAQLIR |
| 592 | gamma-gliadin | DQ2-y -II y-Glia (p222-p236; E229) | Immunogenic | Deamidated | DQ2 | 57 | 15 | GQGIIQPEQPAQLIR |
| 593 | gamma-gliadin | gamma5-gliadin (p227-p237); gamma-11 epitope | Immunogenic | Native | DQ2 | 25 | 11 | GIIQPQQPAQL |
| 594 | gamma-gliadin | gamma5-gliadin (p227-237; E232) | Immunogenic | Deamidated | DQ2 | 25 | 11 | GIIQPEQPAQL |
| 595 | gamma-gliadin | gamma5-gliadin (p228-237) | Immunogenic | Native | DQ2 | 47, 25 | 10 | IIQPQQPAQL |
| 596 | gamma-gliadin | gamma5-gliadin (p228-237; E232) | Immunogenic | Deamidated | DQ2 | 47, 25 | 10 | IIQPEQPAQL |
| 597 | gamma-gliadin | gamma-2 peptide 1306; Glia-gamma30-gliadin (p227-p235) minimal epitope | Immunogenic | Native | DQ2 | 19, 23, 2 | 9 | IIQPQQPAQ |
| 598 | gamma-gliadin | gamma-2 peptide 1306; Glia-gamma30-gliadin (p228-p235; E232) minimal epitope | Immunogenic | Deamidated | DQ2 | 19 | 9 | IIQPEQPAQ |
| 599 | gamma-5 gliadin | glia-gamma 2 | Immunogenic | Native | DQ2.5 | 90, 8, 25 | 9 | IQPQQPAQL |
| 600 | gamma-5 gliadin | glia-gamma 2 | Immunogenic | Deamidated | DQ2.5 | 90, 8, 25 | 9 | IQPEQPAQL |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 601 | gamma-gliadin | gamma-gliadin 1381 (p121-p140); gamma-gliadin M13 M36999 (121-140) identical to DQ2-gamma-I | Immunogenic | Native | DQ2, DQ8 | 17, 23 | 20 | QFPQPQQQSFPQQQQPAI |
| 602 | gamma-gliadin | DQ2-gamma-I gamma-Glia (p139-p153) | Immunogenic | Native | DQ2 | 57 | 15 | PQQPQQSFPQQQQPA |
| 603 | gamma-gliadin | DQ2-gamma-I gamma-Glia (p139-p153; E147) | Immunogenic | Deamidated | DQ2 | 57 | 15 | PQQPQQSFPEQQQPA |
| 604 | gamma-gliadin | DQ2-gamma-I gamma-Glia (p139-p153; E150) | Immunogenic | Deamidated | DQ2 | 57 | 15 | PQQPQQSFPQQEQPA |
| 605 | gamma-gliadin | DQ2-gamma-I gamma-Glia (p139-p153; E147 and E150) | Immunogenic | Deamidated | DQ2 | 57 | 15 | PQQPQQSFPEQEQPA |
| 606 | gamma-gliadin | gamma-gliadin 1382 (p131-p150) | Immunogenic | Native | DQ8 | 17 | 20 | SFPQQQQPAIQSFLQQM |
| 607 | gamma-gliadin | gamma-gliadin 1383 (p141-p160) | Immunogenic | Native | DQ8 | 17 | 20 | QSFLQQQMNPCKNFLLQQCN |
| 608 | gamma-gliadin | gamma-gliadin 1388 (p201-p220) | Immunogenic | Native | DQ2 | 17 | 20 | IHSVAHSIIMQQEQQGVPI |
| 609 | gamma-gliadin | gamma-gliadin M23 M36999 (221-240) homologous to DQ2-gamma-II | Immunogenic | Native | DQ2 | 17, 23 | 20 | LRPLFQLAQGLGIIQPQQPA |
| 610 | gamma-gliadin | gamma-gliadin 1391 (p231-p250); gamma-gliadin M24 M36999 (231-250) identical to DQ2-gamma-II | Immunogenic | Native | DQ2 | 17, 23 | 20 | LGIIQPQQPAQLEGIRSLVL |
| 611 | gamma-gliadin | Gluten peptide E19019 | Immunogenic | Native | DQ2 (DQ2.5) | 61 | 18 | PHQPQQQVPQPQQPQQPF |
| 612 | gamma-gliadin | Predicted gamma-gliadin | Immunogenic | Native | DQ8 (DQ2/8) | 22, 8 | 14 | QQPFPQQPQQPFFPQ |
| 613 | gamma-gliadin | Glia-gamma2 | Immunogenic | Native | DQ2 | 8 | 14 | QQPFPEQPQPFFPQ |
| 614 | gamma-gliadin | Glia-gamma2 in Deamidated form | Immunogenic | Deamidated | DQ2 | 8 | 14 | QQPFPQQPEQPFFPQ |
| 615 | gamma-gliadin | Glia-gamma2 in Deamidated form | Immunogenic | Deamidated | DQ2 | 8 | 14 | QQPFPEQPQPFFPQ |
| 616 | gamma-gliadin | gamma-gliadin P08453 (p94-p113) | Immunogenic | Deamidated | DQ8 | 54 | 20 | QTQPQQPFPQQPQQPFPQT |
| 617 | gamma-gliadin | Predicted gamma-gliadin | Immunogenic | Native | DQ8 (DQ2/8) | 22 | 14 | PFPQLQQPQQPFFPQ |
| 618 | gamma-gliadin | gamma-I gliadin 1206 | Immunogenic | Native | DQ2 | 2 | 21 | YQQLPQPQQPQQSFPQQQRPF |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 619 | gamma-gliadin | gamma-type gliadin of GDB2_WHEAT (SwissProt P08453) (p134-p153) | Immunogenic | Deamidated | DQ2 | 24 | 20 | QQLPQPQQSFP QQQRPF |
| 620 | gamma-gliadin | Glia-gamma1 epitope | Immunogenic | Native | DQ2 | 9 | 17 | QPQQPQQSFPQQQR PFI |
| 621 | gamma-gliadin | Glia-gamma1 (p138-p153) | Immunogenic | Native | DQ2 | 19 | 16 | QPQQPQQSFPQQQR PF |
| 622 | gamma-gliadin | Glia-gamma1 (p139-p153) | Immunogenic | Native | DQ2 | 8 | 15 | PQQPQQSFPQQQRP F |
| 623 | gamma-gliadin | Glia-gamma1 (p139-p153; E148) | Immunogenic | Deamidated | DQ2 | 8 | 15 | PQQPQQSFPEQQRP F |
| 624 | gamma-gliadin | Glia-gamma1 (p139-p153; E140 and E148) | Immunogenic | Deamidated | DQ2 | 8 | 15 | PEQPQQSFPEQQRP F |
| 625 | gamma-gliadin | Glia-gamma1 (p139-p153; E148 and E150) | Immunogenic | Deamidated | DQ2 | 8 | 15 | PQQPQQSFPEQERP F |
| 626 | gamma-gliadin | Glia-gamma1 (p139-p153; E140, E148 and E150) | Immunogenic | Deamidated | DQ2 | 8 | 15 | PEQPQQSFPEQERP F |
| 627 | gamma-gliadin | gamma-I, gamma-Gliadin (p139-p152) | Immunogenic | Native | DQ2 | 43, 25 | 14 | PQQPQQSFPQQQRP |
| 628 | gamma-gliadin | gamma-Gliadin (p139-p152; E140, E148 and E150) E residues in the gliadin peptides are introduced to mimic the deamidation mediated by tissue transglutaminase. | Immunogenic | Deamidated | DQ2 | 43, 25 | 14 | PEQPQQSFPEQERP |
| 629 | gamma-gliadin | gamma-gliadin (p139-p152; E148) | Immunogenic | Deamidated | DQ2 | 55 | 14 | PQQPQQSFPEQQRP |
| 630 | gamma-gliadin | gamma-gliadin (p139-p152; E140 and E148) | Immunogenic | Deamidated | DQ2 (DQ2.2 and DQ2.5)25 | 14 | 14 | PEQPQQSFPEQQRP |
| 631 | gamma-gliadin | P-3 gamma-gliadin (p139-p152; K139, E140, E148 and E150) | Immunogenic | Synthesised as Deamidated | DQ2 | 56 | 14 | KEQPQQSFPEQERP |
| 632 | gamma-gliadin | P-2 gamma-gliadin (p139-p152; K140, E148 and E150) | Immunogenic | Synthesised as Deamidated | DQ2 | 56 | 14 | PKQPQQSFPEQERP |
| 633 | gamma-gliadin | P-1 gamma-gliadin (p139-p152; K141, E140, E148 and E150) | Immunogenic | Synthesised as Deamidated | DQ2 | 56 | 14 | PEKPQQSFPEQERP |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 634 | gamma-gliadin | P1 y-gliadin(p139-p152; K142, E140, E148 and E150) | Immunogenic | Synthesised as Deamidated | DQ2 | 56 | 14 | PEQKQQSFPEQERP |
| 635 | gamma-gliadin | P2 y-gliadin (p139-p152; K143, E140, E148 and E150) | Immunogenic | Synthesised as Deamidated | DQ2 | 56 | 14 | PEQPKQSFPEQERP |
| 636 | gamma-gliadin | P4 y-gliadin (p139-p152; K144, E140, E148 and E150) | Immunogenic | Synthesised as Deamidated | DQ2 | 56 | 14 | PEQQKPFPEQERP |
| 637 | gamma-gliadin | P9 gamma-gliadin (p139-p152; E140, E148 and K150) | Immunogenic | Synthesised as Deamidated | DQ2 | 56 | 14 | PEQQQSFPEQKRP |
| 638 | gamma-gliadin | P10 gamma-gliadin (p139-p152; K151, E140, E148 and E150) | Immunogenic | Synthesised as Deamidated | DQ2 | 56 | 14 | PEQQQSFPEQEKP |
| 639 | gamma-gliadin | P11 y-gliadin (p139-p152; K152, E140, E148 and E150) | Immunogenic | Synthesised as Deamidated | DQ2 | 56 | 14 | PEQQQSFPEQERK |
| 640 | gamma-gliadin | gamma-I epitope in native form | Immunogenic | Native | DQ2 | 47 | 12 | QPQQSFPQQQRP |
| 641 | gamma-gliadin | Deamidated form of gamma-I epitope | Immunogenic | Deamidated | DQ2 | 47 | 12 | QPQQSFPEQQRP |
| 642 | gamma-gliadin | Glia-alpha20 | Immunogenic | Native | DQ2 | 9 | 16 | QQSFPQQQRPFIQPSL |
| 643 | gamma-gliadin | gamma-gliadin AAK84772 (p130-p149) | Immunogenic | Native | DQ8 | 54 | 20 | PQPQPQLPFPQQPQQPFPQ |
| 644 | gamma-gliadin | Predicted gamma-gliadin | Immunogenic | Native | DQ8 (DQ2/8) | 22 | 14 | PFPQPQQPQQPFFQ |
| 645 | gamma-gliadin | gamma-gliadin AAK84776 (p102-p121) | Immunogenic | Native | DQ8 | 54 | 20 | QQPLPQPQQPQQPFPQSQP |
| 646 | gamma-gliadin | gamma-gliadin AAK84772 (p121-p140) | Immunogenic | Native | DQ8 | 54 | 20 | QPQQPQQPFPQQQPLIQPY |
| 647 | gamma-gliadin | Wheat peptide W35 | Immunogenic | Native | DQ2 | 62 | 20 | PQQPFPQQPQQQFPQPQQPQ |
| 648 | gamma-gliadin | Wheat peptide W35 | Immunogenic | Native | DQ2 | 62 | 12 | PFPQQPQQQFPQ |
| 649 | gamma-gliadin | Wheat peptide W31 | Immunogenic | Native | DQ2 | 62 | 20 | QPFPQLQQPQPLPQPQQPQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 650 | gamma-gliadin | Wheat peptide W31 | Immunogenic | Native | DQ2 | 62 | 12 | QPFPQLQQPQQP |
| 651 | LMW glutenin | Wheat peptide W15 LMW | Immunogenic | Native | DQ2 | 62 | 20 | SHIPGLERPWQQQPLPPQQT |
| 652 | LMW glutenin | Wheat peptide W15 LMW | Immunogenic | Native | DQ2 | 62 | 15 | QGLERPWQQQPLPPQ |
| 653 | LMW glutenin | Wheat peptide W15 LMW | Immunogenic | Deamidated | DQ2 | 62 | 15 | EGLERPWQEQPLPPQ |
| 654 | LMW glutenin | Wheat peptide W15 LMW | Immunogenic | Native | DQ2 | 62 | 12 | LERPWQQQPLPP |
| 655 | LMW glutenin | Wheat peptide W11 | Immunogenic | Deamidated | DQ2 | 62 | 16 | GQQAFPQPEQTFPHQG |
| 656 | LMW glutenin | Wheat peptide W11 | Immunogenic | Native | DQ2 | 62 | 15 | QQAFPQPQQTFPHQP |
| 657 | LMW glutenin | Wheat peptide W11 | Immunogenic | Deamidated | DQ2 | 62 | 15 | EQAFPQPQQTFPHQP |
| 658 | LMW glutenin | Wheat peptide W11 | Immunogenic | Native | DQ2 | 62 | 20 | QAFPQPQQTFPHQPQQQFPQ |
| 659 | LMW glutenin | Wheat peptide W11 | Immunogenic | Native | DQ2 | 62 | 12 | QAFPQPQQTFPH |
| 660 | LMW glutenin | Wheat peptide W11 | Immunogenic | Deamidated | DQ2 | 62 | 12 | QAFPQPEQTFPH |
| 661 | gamma-gliadin or LMW | Glutenin-Glt-17 (p46-p60) | Immunogenic | Native | DQ2 | 19 | 15 | QQPPFSQQQQQPLPQ |
| 662 | gamma-gliadin or LMW | Glutenin-Glt-17 (p46-p60; E52) | Immunogenic | Deamidated | DQ2 | 19 | 15 | QQPPFSEQQQQPLPQ |
| 663 | gamma-gliadin or LMW | Glutenin-Glt-17 (p46-p60; E53) | Immunogenic | Deamidated | DQ2 | 19 | 15 | QQPPFSQEQQQPLPQ |
| 664 | gamma-gliadin or LMW | Glutenin-Glt-17 (p46-p60; E55) | Immunogenic | Deamidated | DQ2 | 19 | 15 | QQPPFSQQQEQPLPQ |
| 665 | gamma-gliadin or LMW | Glutenin-Glt-17 (p46-p60; E56) | Immunogenic | Deamidated | DQ2 | 19 | 15 | QQPPFSQQQQEPLPQ |
| 666 | gamma-gliadin or LMW | Glutenin-Glt-17 (p46-p60; E52 and 53) | Immunogenic | Deamidated | DQ2 | 19 | 15 | QQPPFSEEQQQPLPQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 667 | gamma-gliadin or LMW | gluteninGlutenin-Glt-17 (p46-p60; E52 and 55) | Immunogenic | Deamidated | DQ2 | 19 | 15 | QQPPFSEQQEQPLPQ |
| 668 | gamma-gliadin or LMW | gluteninGlutenin-Glt-17 (p46-p60; E52 and 56) | Immunogenic | Deamidated | DQ2 | 19 | 15 | QQPPFSQQEQPLPQ |
| 669 | gamma-gliadin or LMW | gluteninGlutenin-Glt-17 (p46-p60; E53 and 55) | Immunogenic | Deamidated | DQ2 | 19 | 15 | QQPPFSQEQEQPLPQ |
| 670 | gamma-gliadin or LMW | gluteninGlutenin-Glt-17 (p46-p60; E53 and 56) | Immunogenic | Deamidated | DQ2 | 19 | 15 | QQPPFSQQEQPLPQ |
| 671 | gamma-gliadin or LMW | gluteninGlutenin-Glt-17 (p46-p60; E55 and 56) | Immunogenic | Deamidated | DQ2 | 19 | 15 | QQPPFSQQQEEPLPQ |
| 672 | gamma-gliadin or LMW | gluteninGlutenin-Glt-17 (p46-p60; E52, 53 and 55) | Immunogenic | Deamidated | DQ2 | 19 | 15 | QQPPFSEQEQPLPQ |
| 673 | gamma-gliadin or LMW | gluteninGlutenin-Glt-17 (p46-p60; E52, 53 and 56) | Immunogenic | Deamidated | DQ2 | 19 | 15 | QQPPFSEQQEQPLPQ |
| 674 | gamma-gliadin or LMW | gluteninGlutenin-Glt-17 (p46-p60; E53, 55 and 56) | Immunogenic | Deamidated | DQ2 | 19 | 15 | QQPPFSQEQEEPLPQ |
| 675 | gamma-gliadin or LMW | gluteninGlutenin-Glt-17 (p46-p60; E52, 55 and 56) | Immunogenic | Deamidated | DQ2 | 19 | 15 | QQPPFSEQQEEPLPQ |
| 676 | gamma-gliadin or LMW | gluteninGlutenin-Glt-17 (p46-p60; E52, 53, 55 and 56) | Immunogenic | Deamidated | DQ2 | 19 | 15 | QQPPFSEQEEPLPQ |
| 693 | gamma-gliadin or LMW | gluteninGlutenin-Glt-17 CAUTION 100% matches to 5 microbial proteins and to wheat proteins Glutenin-Glt-17 (p50-p58) | Immunogenic | Native | DQ2 | 27 | 9 | FSQQQQQPL |
| 694 | gamma-gliadin or LMW lutenin | Glutenin-Glt-17 (p50-p58; E52) | Immunogenic | Deamidated | DQ2 | 27 | 9 | FSEQQQQPL |
| 695 | gamma-gliadin or LMW lutenin | CAUTION 100% matches to two Pinus proteins/not wheat Glutenin-Glt-17 (p50-p58; E53) | Immunogenic | Deamidated | DQ2 | 27 | 9 | FSQEQQQPL |
| 696 | gamma-gliadin or LMW lutenin | Glutenin-Glt-17 (p50-p58; E55) | Immunogenic | Deamidated | DQ2 | 27 | 9 | FSQQQEQPL |
| 697 | gamma-gliadin or LMW lutenin | Glutenin-Glt-17 (p50-p58; E52 and E53) | Immunogenic | Deamidated | DQ2 | 27 | 9 | FSEEQQQPL |
| 698 | gamma-gliadin or LMW lutenin | Glutenin-Glt-17 (p50-p58; E52 and E55) | Immunogenic | Deamidated | DQ2 | 27 | 9 | FSEQQEQPL |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 699 | gamma-gliadin or LMW lutenin | Glutenin-Glt-17 (p50-p58; E53 and E55) | Immunogenic | Deamidated | DQ2 | 27 | 9 | FSQEBQPL |
| 700 | gamma-gliadin or LMW lutenin | Glutenin-Glt-17 (p50-p58; E52, E53 and E55) | Immunogenic | Deamidated | DQ2 | 27 | 9 | FSEEQQEPL |
| 701 | gamma-gliadin or LMW lutenin | Glutenin-17 epitope homolog | Immunogenic | Native | DQ2 | 8, 19 | 15 | QQPPFSQQQQPVLPQ |
| 702 | gamma-gliadin or LMW lutenin | Glutenin-17 epitope homolog in Deamidated form | Immunogenic | Deamidated | DQ2 | 8 | 15 | QQPPFSEQQQPVLPQ |
| 703 | gamma-gliadin or LMW lutenin | Glutenin-17 epitope homolog in Deamidated form | Immunogenic | Deamidated | DQ2 | 8 | 15 | QQPPFSQQEQPVLPQ |
| 704 | gamma-gliadin or LMW lutenin | Glutenin-17 epitope homolog in Deamidated form | Immunogenic | Deamidated | DQ2 | 8 | 15 | QQPPFSEQEQPVLPQ |
| 705 | gamma-gliadin or LMW lutenin | LMW T cell epitope | Immunogenic | Deamidated | DQ2 | 62 | 15 | EQPPFSEQEQPVLPQ |
| 706 | Glut-L1 | CAUTION 100% match to a fungal protien Hebeloma sp. & many wheat Glt-17 (Van) | Immunogenic | Native | DQ2.2 | 44, 90 | 9 | PFSQQQQPV |
| 707 | glut-L1 | Glt-17 (Van) | Immunogenic | Deamidated | DQ2.2 | 44, 90 | 9 | PFSEQQQPV |
| 708 | glut-L1 | Glt-17 (Van) | Immunogenic | Deamidated | DQ2.2 | 44, 90 | 9 | PFSQQEQPV |
| 709 | glut-L1 | Glt-17 (Van) | Immunogenic | Deamidated | DQ2.2 | 44, 90 | 9 | PFSEQEQPV |
| 710 | gamma-gliadin or LMW-lutenin | Wheat peptide W12 | Immunogenic | Native | DQ2 | 62 | 20 | CKVFLQQQCSPVAMPQRLAR |
| 711 | gamma-gliadin or LMW-lutenin | Wheat peptide W12 | Immunogenic | Native | DQ2 | 62 | 16 | LQQQCSPVAMPQRLAR |
| 712 | gamma-gliadin or LMW-lutenin | Wheat peptide W05 | Immunogenic | Native | DQ2 | 62 | 20 | PQQQQPFPQPQQPFSQQPQQ |
| 713 | gamma-gliadin or LMW-lutenin | Wheat peptide W05 | Immunogenic | Deamidated | DQ2 | 62 | 20 | PQQQQPFPQPEQPFSQQPQQ |
| 714 | gamma-gliadin or LMW-lutenin | Wheat peptide W05 | Immunogenic | Native | DQ2 | 62 | 12 | QPFPQPQQPFSQ |
| 715 | gamma-gliadin or LMW-lutenin | Wheat peptide W05 | Immunogenic | Deamidated | DQ2 | 62 | 12 | QPFPQPEQPFSQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 716 | gamma-gliadin or LMW-lutenin | Wheat peptide W17 | Immunogenic | Native | DQ2 | 62 | 20 | QQPFPQPQQPQLPFPQQPQQ |
| 717 | gamma-gliadin or LMW-lutenin | Wheat peptide W17 | Immunogenic | Native | DQ2 | 62 | 15 | QPFPQPQQPQLPFPQ |
| 718 | gamma-gliadin or LMW-lutenin | Wheat peptide W17 | Immunogenic | Deamidated | DQ2 | 62 | 15 | EPFPQPEQPELPFPQ |
| 719 | gamma-gliadin or LMW-lutenin | Wheat peptide W17 | Immunogenic | Native | DQ2 | 62 | 12 | QPFPQPQQPQLP |
| 720 | LMW glutenin | GLT/GLIA homologue peptide 12 | Immunogenic | Native | DQ2 | 19 | 15 | QQPPFSQQQPPFSQ |
| 721 | LMW glutenin | LMW glutenin-glt-156 (p40-p59) | Immunogenic | Deamidated | DQ2 | 19 | 20 | QQQQPPFSQQQQSPFSQQQQ |
| 722 | LMW glutenin | LMW glutenin-glt-156 (p40-p59; E48) | Immunogenic | Deamidated | DQ2 | 19 | 20 | QQQQPPFSEQQQSPFSQQQQ |
| 723 | LMW glutenin | LMW glutenin-glt-156 (p40-p59; E51) | Immunogenic | Deamidated | DQ2 | 19 | 20 | QQQQPPFSQQQESPFSQQQQ |
| 724 | LMW glutenin | LMW glutenin-glt-156 (p40-p59; E48 and E51) | Immunogenic | Deamidated | DQ2 | 19 | 20 | QQQQPPFSEQQESPFSQQQQ |
| 725 | LMW glutenin | Homolog of Deamidated Glt-156 minimal epitope (p40-p59) | Immunogenic | Deamidated | DQ2 | 20 | 15 | QQQQPPFSEQESPY |
| 726 | LMW glutenin | Homolog of Deamidated Glt-156 minimal epitope (p40-p59) | Immunogenic | Deamidated | DQ2 | 20 | 15 | QQQQPPFSEQESPL |
| 727 | LMW glutenin | Deamidated Glt-156 minimal epitope (p40-p59) | Immunogenic | Deamidated | DQ2 | 20 | 15 | QQQQPPFSEQESPF |
| 728 | LMW glutenin | Glt-156 minimal epitope (p41-p55) | Immunogenic | Deamidated | DQ2 | 20 | 15 | QQQPPFSEQESPS |
| 729 | LMW glutenin | Glt-156 minimal epitope in considered native form | Immunogenic | Native | DQ2 | 20 | 15 | QQPPFSQQQSPFFS |
| 730 | LMW glutenin | Glt-156 minimal epitope in considered Deamidated form | Immunogenic | Deamidated | DQ2 | 20 | 15 | QQPPFSEQESPFFS |
| 731 | LMW glutenin | GLT/GLIA homologue peptide 4 | Immunogenic | Native | DQ2 | 19 | 12 | QQPPFSQQQSP |
| 732 | LMW glutenin | Glt-156 minimal epitope | Immunogenic | Deamidated | DQ2 | 20 | 15 | QPPFSEEQESPFSQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 733 | LMW glutenin | LMW glutenin-glt-156 (p40-p59) | Immunogenic | Native | DQ2 | 16 | 14 | QPPFSQQQSPFSQ |
| 734 | LMW glutenin | Glt-156 minimal epitope in considered native form | Immunogenic | Native | DQ2 | 20 | 15 | PPFSQQQQSPFSQQQ |
| 735 | LMW glutenin | Glt-156 minimal epitope in considered Deamidated form | Immunogenic | Deamidated | DQ2 | 20 | 15 | PPFSEEQESPFSQQQ |
| 736 | LMW glutenin | Glt-156 minimal epitope in considered native form | Immunogenic | Native | DQ2 | 20 | 15 | PFSQQQQSPFSQQQQ |
| 737 | LMW glutenin | Glt-156 minimal epitope in considered Deamidated form | Immunogenic | Deamidated | DQ2 | 20 | 15 | PFSEEQESPFSQQQQ |
| 738 | LMW glutenin | LMW glutenin-glt-156 (p45-p54) minimal epitope | Immunogenic | Native | DQ2 | 19, 20 | 10 | PFSQQQQSPF |
| 739 | LMW glutenin | LMW glutenin-glt-156 (p45-p54; E48) minimal epitope | Immunogenic | Deamidated | DQ2 | 19, 20 | 10 | PFSEQQQSPF |
| 740 | LMW glutenin | LMW glutenin-glt-156 (p45-p54; E49) minimal epitope | Immunogenic | Deamidated | DQ2 | 20 | 10 | PFSQEQQSPF |
| 741 | LMW glutenin | LMW glutenin-glt-156 (p45-p54; E51) minimal epitope | Immunogenic | Deamidated | DQ2 | 19, 20 | 10 | PFSQQQESPF |
| 742 | LMW glutenin | LMW glutenin-glt-156 (p45-p54; E48 and E49) minimal epitope | Immunogenic | Deamidated | DQ2 | 19, 20 | 10 | PFSEEQQSPF |
| 743 | LMW glutenin | LMW glutenin-glt-156 (p45-p54; E48 and E49) minimal epitope | Immunogenic | Deamidated | DQ2 | 20 | 10 | PFSEQESPF |
| 745 | LMW glutenin | LMW glutenin-glt-156 (p45-p54; E49 and E49) minimal epitope | Immunogenic | Deamidated | DQ2 | 20 | 10 | PFSQEQESPF |
| 746 | LMW glutenin | LMW glutenin-glt-156 (p45-p54; E48, E49 and E51) minimal epitope | Immunogenic | Deamidated | DQ2 | 20 | 10 | PFSEEQESPF |
| 747 | glut-L2 | LMW glutenin-glt-156 (p46-p54) | Immunogenic | Native | DQ2.5 | 19, 90, 27 | 9 | FSQQQQSPF |
| 748 | glut-L2 | LMW glutenin-glt-156 (p46-p54; E48) | Immunogenic | Deamidated | DQ2.5 | 19, 90, 27 | 9 | FSEQQQSPF |
| 749 | glut-L2 | LMW glutenin-glt-156 (p46-p54; E49) | Immunogenic | Deamidated | DQ2.5 | 19, 90, 27 | 9 | FSQQQESPF |
| 750 | glut-L2 | LMW glutenin-glt-156 (p46-p54; E51) | Immunogenic | Deamidated | DQ2.5 | 19, 90, 27 | 9 | FSEQQESPF |
| 751 | LMW glutenin | GLT/GLIA homologue peptide 13 | Immunogenic | Native | DQ2 | 19 | 15 | QQPPFSQQQQPQFSQ |
| 752 | LMW glutenin | Gluten peptide E19025 | Immunogenic | Native | DQ2 (DQ2.5) | 61 | 19 | SHQQQPFQQQPYPQQPYPS |

TABLE 6-continued

The sequences are, in the order presented, SEQ ID NOs: 1000-2012.

| ID | Type | Description | Toxicity | Form | HLADQ | Refs | SeqLen | Sequence |
|----|------|-------------|----------|------|-------|------|--------|----------|
| 753 | gamma-gliadin | 14-mer-2 gamma-Glia (p173-p186) | Immunogenic | Native | DQ2 | 57 | 14 | PQQPFPSQQQQPLI |
| 754 | gamma-gliadin | 14-mer-2 gamma-Glia (p173-p186) in Deamidated form | Immunogenic | Deamidated | DQ2 | 57 | 14 | PQQPFPSQQEQPLI |
| 755 | LMW glutenin | GLT/GLIA homologue peptide 17 | Immunogenic | Native | DQ2 | 19 | 15 | QQPPFSQQQQPILPQ |
| 756 | LMW glutenin | Glt-156 homolog | Immunogenic | Native | DQ2 | 21 | 14 | QPPFSQQQQPILPQ |
| 757 | LMW glutenin | Glt-156 homolog in Deamidated form | Immunogenic | Deamidated | DQ2 | 21 | 14 | QPPFSEQQPILPQ |
| 762 | LMW glutenin | GLT/GLIA homologue peptide 16 | Immunogenic | Native | DQ2 | 19 | 15 | QQPPFSQQQQQPILL |
| 763 | LMW glutenin | Glt-156 homolog | Immunogenic | Native | DQ2 | 21 | 14 | QPPFSQQQQPILL |
| 764 | LMW glutenin | Glt-156 homolog in Deamidated form | Immunogenic | Deamidated | DQ2 | 21 | 14 | QPPFSEEQEQPILL |
| 765 | HMW glutenin | Wheat peptide W21 HMW | Immunogenic | Native | DQ2 | 62 | 20 | QGQGYYPTSPQQSGQGQP |
| 766 | HMW glutenin | Wheat peptide W21 HMW | Immunogenic | Native | DQ2 | 62 | 16 | QGQGYYPISPQQSGQ |
| 767 | HMW glutenin | Wheat peptide W21 HMW | Immunogenic | Deamidated | DQ2 | 62 | 16 | EGQQGYYPISPQQSGQ |
| 768 | HMW glutenin | Naturally occurring glutenins p722-p736 (homolog of glt04) | Immunogenic | Native | DQ8 (DQ2/8) | 7 | 15 | GQAGYYPTSPQQSGQ |
| 769 | HMW glutenin | Naturally occurring glutenins p722-p736 (homolog of glt04) | Immunogenic | Native | DQ8 (DQ2/8) | 7 | 15 | GQQGYYPTSPQQPGQ |
| 770 | HMW glutenin | Naturally occurring glutenins p722-p736 (homolog of glt04) | Immunogenic | Native | DQ8 (DQ2/8) | 7 | 15 | GQQGYYPISPQQSGQ |
| 771 | HMW glutenin | Wheat peptide W29 | Immunogenic | Native | DQ2 | 62 | 20 | GQQGSGYYPTSPQQSGQEAT |
| 772 | HMW glutenin | Wheat peptide W29 | Immunogenic | Native | DQ2 | 62 | 16 | GQQGSGYYPTSPQQSG |
| 773 | HMW glutenin | Wheat peptide W24 HMW | Immunogenic | Native | DQ2 | 62 | 20 | PGQGQSGYYPTSPQQSGQKQ |
| 774 | HMW glutenin | Wheat peptide W24 HMW | Immunogenic | Native | DQ2 | 62 | 16 | PGQGQSGYYPTSPQQS |

TABLE 6-continued

The sequences are, in the order presented, SEQ ID NOs: 1000-2012.

| ID | Type | Description | Form | Toxicity | HLADQ | Refs | SeqLen | Sequence |
|---|---|---|---|---|---|---|---|---|
| 775 | HMW glutenin | Naturally occurring glutenins (p722-p736) (homolog of glt04) | Native | Immunogenic | DQ8 (DQ2/8) | 7 | 15 | GQGYYPTSPQQSGQ |
| 776 | HMW glutenin | Naturally occurring glutenins (p722-p736) (homolog of glt04) | Native | Immunogenic | DQ8 (DQ2/8) | 7 | 15 | GQQGYYPISPQQLGQ |
| 777 | HMW glutenin | Naturally occurring glutenins (p722-p736) (homolog of glt04) | Native | Immunogenic | DQ8 (DQ2/8) | 7 | 15 | GQLGYYPTSPQQSGQ |
| 778 | HMW glutenin | Wheat peptide W22 HMW | Native | Immunogenic | DQ2 | 62 | 20 | LQPGQGQPGYYPTSPQQIGQ |
| 779 | HMW glutenin | Wheat peptide W22 HMW | Native | Immunogenic | DQ2 | 62 | 16 | QGQPGYYPTSPQQIGQ |
| 780 | HMW glutenin | Naturally occurring glutenins (p722-p736) (homolog of glt04) | Native | Immunogenic | DQ8 (DQ2/8) | 7 | 15 | GQPGYYPTSPQQIGQ |
| 781 | HMW glutenin | Naturally occurring glutenins (p722-p736) (homolog of glt04) | Native | Immunogenic | DQ8 (DQ2/8) | 7 | 15 | GQPGYYPTSPQQPGQ |
| 782 | HMW glutenin | Naturally occurring glutenins (p722-p736) (homolog of glt04) | Native | Immunogenic | DQ8 (DQ2/8) | 7 | 15 | GQGYYPTSPQQSGQ |
| 783 | HMW glutenin | Naturally occurring glutenins p722-p736 (homolog of glt04) | Native | Immunogenic | DQ8 (DQ2/8) | 7 | 15 | GQGYYPTSLQQPGQ |
| 784 | HMW-Glutenin | HMW glutenin-glt04 (p707-p742) | Native | Immunogenic | DQ8 (DQ2/8) | 7 | 36 | SGQGQRPGQWLQPGQGQQGYYPTSPQQSGQQQLGQ |
| 785 | HMW-Glutenin | HMW glutenin-glt04 (p719-p736) | Native | Immunogenic | DQ8 (DQ2/8) | 7 | 18 | PGQGQQGYYPTSPQQSGQ |
| 786 | HMW-Glutenin | glt04 (p722-p736) | Native | Immunogenic | DQ8 (DQ2/8) | 7 | 15 | GQQGYYPTSPQQSGQ |
| 787 | HMW-Glutenin | glt04 (p722-p735) | Native | Immunogenic | DQ8 (DQ2/8) | 7 | 14 | GQQGYYPTSPQQSG |
| 788 | HMW-Glutenin | glt04 (p722-p734) | Native | Immunogenic | DQ8 (DQ2/8) | 7 | 13 | GQQGYYPTSPQQS |
| 789 | HMW-Glutenin | glt04 (p723-p736) | Native | Immunogenic | DQ8 (DQ2/8) | 7 | 14 | QQGYYPTSPQQSGQ |
| 790 | HMW-Glutenin | glt04 (p723-p735) | Native | Immunogenic | DQ8 (DQ2/8) | 7 | 13 | QQGYYPTSPQQSG |
| 791 | HMW-Glutenin | glt04 (p723-p735; E724) | Deamidated | Immunogenic | DQ8 (DQ2/8) | 7, 83 | 13 | QEGYYPTSPQQSG |
| 792 | HMW-Glutenin | glt04 (p723-p734) | Native | Immunogenic | DQ8 (DQ2/8) | 52 | 12 | QQGYYPTSPQQS |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 793 | HMW-Glutenin | glt04 (p724-p735) | Immunogenic | Native | DQ8 (DQ2/8) | 7 | 12 | QGYYPTSPQQSG |
| 794 | glut-H1 | HMW glutenin (p724-p734) | Immunogenic | Native | DQ8, DQ8.5 | 7, 76, 27 | 11 | QGYYPTSPQQS |
| 797 | HMW-Glutenin | glt04 (p725-p735) | Immunogenic | Native | DQ8 (DQ8.5) | 7, 83 | 11 | GYYPTSPQSG |
| 798 | HMW-Glutenin | Naturally occurring glutenins (p722-p736) (homolog of glt04) | Immunogenic | Native | DQ8 (DQ2/8) | 7 | 15 | GQQGYYPTSPQQPGQ |
| 799 | HMW-Glutenin | Naturally occurring glutenins (p722-p736) (homolog of glt04) | Immunogenic | Native | DQ8 (DQ2/8) | 7 | 15 | GQQGYYPTSPQQSPQ |
| 800 | HMW-Glutenin | Naturally occurring glutenins (p722-p736) (homolog of glt04) | Immunogenic | Native | DQ8 (DQ2/8) | 7 | 15 | GQQGYYPTSPQQLGQ |
| 801 | HMW-Glutenin | Naturally occurring glutenins (p722-p736) (homolog of glt04) | Immunogenic | Native | DQ8 (DQ2/8) | 7 | 15 | GQQGYYPTSPQHPGQ |
| 802 | HMW-Glutenin | Naturally occurring glutenins (p722-p736) (homolog of glt04) | Immunogenic | Native | DQ8 (DQ2/8) | 7 | 15 | GQPGYYPTSPLQSGQ |
| 803 | HMW-Glutenin | Naturally occurring glutenins (p722-p736) (homolog of glt04) | Immunogenic | Native | DQ8 (DQ2/8) | 7 | 15 | GQHGYYPTSPLSGQ |
| 804 | HMW-Glutenin | Naturally occurring glutenins (p722-p736) (homolog of glt04) | Immunogenic | Native | DQ8 (DQ2/8) | 7 | 15 | GQQGYYPTSPQPPQ |
| 805 | HMW-Glutenin | Naturally occurring glutenins (p722-p736) (homolog of glt04) | Immunogenic | Native | DQ8 (DQ2/8) | 7 | 15 | GQQGYYPTSVQQPGQ |
| 806 | Hordein | Barley peptide B04, B17 | Immunogenic | Native | DQ2 | 62 | 20 | QPQQPQPFPQQPVPQQPQPY |
| 807 | Hordein | Barley peptide B17 | Immunogenic | Native | DQ2 | 62 | 16 | PQQPQPFPQQPVPQQP |
| 808 | Hordein | Barley peptide B04 | Immunogenic | Native | DQ2 | 62 | 12 | PQQPVPQQPPY |
| 809 | Hordein | Barley peptide B05, B08 in native form | Immunogenic | Native | DQ2 | 62 | 20 | PQPFPQQPIPQQPPYPQQP |
| 810 | Hordein | Barley peptide B05, B08 in Deamidated form | Immunogenic | Deamidated | DQ2 | 62 | 20 | PQPFPQQPIPEQPQPYPQQP |
| 811 | Hordein | Barley peptide B05 | Immunogenic | Native | DQ2 | 62 | 16 | PQPFPQQPIPQQPPY |
| 812 | Hordein | Barley peptide B05 | Immunogenic | Deamidated | DQ2 | 62 | 16 | PQPFPQQPIPEQPQPY |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 813 | Hordein | Barley peptide B06 | Immunogenic | Native | DQ2 | 62 | 20 | QQPQPFSQQPIPQQPQPYPQ |
| 814 | Hordein | Barley peptide B06 | Immunogenic | Deamidated | DQ2 | 62 | 20 | QQQPFSQQPIPEQPQPYPQ |
| 815 | Hordein | Barley peptide B06 | Immunogenic | Native | DQ2 | 62 | 12 | SQQPIPQQPQPY |
| 816 | Hordein | Barley peptide B06 | Immunogenic | Deamidated | DQ2 | 62 | 12 | SQQPIPEQPQPY |
| 817 | Hordein | Barley peptide B18 | Immunogenic | Native | DQ2 | 62 | 20 | QPQPFPQQPIPLQPHQPYTQ |
| 818 | Hordein | Barley peptide B18 | Immunogenic | Native | DQ2 | 62 | 12 | QPQPFPQQPIPL |
| 819 | Hordein | Barley peptide B13 | Immunogenic | Native | DQ2 | 62 | 20 | PQPYPQQPFPQQPPFCQQ |
| 820 | Hordein | Barley peptide B13 | Immunogenic | Native | DQ2 | 62 | 16 | PQPYPQQPFPQQPP |
| 821 | Hordein | Barley peptide B09, B12, B30 | Immunogenic | Native | DQ2 | 62 | 20 | QQPFPQQPFPQQPYPQPPY |
| 822 | Hordein | Barley peptide B09 | Immunogenic | Native | DQ2 | 62 | 16 | QQPFPQQPFPQQPY |
| 823 | Hordein | Barley peptide B30 | Immunogenic | Native | DQ2 | 62 | 11 | QQPFPQQPFPQ |
| 824 | Hordein | Barley peptide B12 | Immunogenic | Native | DQ2 | 62 | 16 | PQQPFPQQPYPQQP |
| 825 | Hordein | Barley peptide B11 | Immunogenic | Native | DQ2 | 62 | 20 | QQPYPQQPQPYPQQPFQPQ |
| 826 | Hordein | Barley peptide B11 | Immunogenic | Native | DQ2 | 62 | 12 | QPQPYPQQPPY |
| 827 | gamma-gliadin or LMW glutenin | Glu-21 in considered native form | Immunogenic | Native | DQ2 | 19 | 21 | QPQPFPQQSEQSQQPFQPQPF |
| 828 | Hordein | Barley peptide B03 | Immunogenic | Native | DQ2 | 62 | 20 | QQQPFPPQQPIPYQPQQP |
| 829 | Hordein | Barley peptide B03 | Immunogenic | Deamidated | DQ2 | 62 | 16 | GQQPFPQPEQPIPYQG |
| 830 | Hordein | Barley peptide B03 | Immunogenic | Native | DQ2 | 62 | 12 | QPFPQPQQPIPY |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 831 | Hordein | Barley peptide B03 | Immunogenic | Deamidated | DQ2 | 62 | 12 | QPFPQPEQPIPY |
| 832 | Hordein | Barley peptide B02 | Immunogenic | Native | DQ2 | 62 | 20 | WQPQQPFPQPQQPFPLQPQQ |
| 833 | Hordein | Barley peptide B02 | Immunogenic | Deamidated | DQ2 | 62 | 20 | WQPQQPFPQEQPFPLQPQQ |
| 834 | Hordein | Barley peptide B02 | Immunogenic | Deamidated | DQ2 | 62 | 16 | GQQPFPQPFPQQPFPLQG |
| 835 | Hordein | Barley peptide B02 | Immunogenic | Native | DQ2 | 62 | 12 | QPFPQPQQPFPL |
| 836 | Hordein | Barley peptide B02 | Immunogenic | Deamidated | DQ2 | 62 | 12 | QPFPQPEQPFPL |
| 837 | Hordein | Barley peptide B19 | Immunogenic | Native | DQ2 | 62 | 20 | LPRPQQPFPWQPQQPFPQPQ |
| 838 | Hordein | Barley peptide B26 | Immunogenic | Native | DQ2 | 62 | 20 | QPQQPFPLQPQQPFPWQPQQ |
| 839 | Hordein | Barley peptide B26 | Immunogenic | Native | DQ2 | 62 | 12 | PFPLQPQQPFPW |
| 840 | Hordein | Barley peptide B29 | Immunogenic | Native | DQ2 | 62 | 20 | QPQQPFSFSQQPQQPFPLQP |
| 841 | Hordein | Barley peptide B29 | Immunogenic | Deamidated | DQ2 | 62 | 16 | GFSFSQQPEQPFPLQG |
| 842 | Hordein | Barley peptide B14 | Immunogenic | Native | DQ2 | 62 | 20 | FQQPQQSYPVQPQQPFPQPQ |
| 843 | Hordein | Barley peptide B14 | Immunogenic | Deamidated | DQ2 | 62 | 16 | GQSYPVQPEQPFPQPG |
| 844 | Hordein | Barley peptide B14 | Immunogenic | Native | DQ2 | 62 | 12 | SYPVQPQQPFPQ |
| 845 | Hordein | Barley peptide B14 | Immunogenic | Deamidated | DQ2 | 62 | 12 | SYPVQPEQPFPQ |
| 846 | Hordein | Barley peptide B29 | Immunogenic | Native | DQ2 | 62 | 12 | SFSQPQQPFPL |
| 847 | Hordein | Barley peptide B29 | Immunogenic | Deamidated | DQ2 | 62 | 12 | SFSQQPEQPFPL |
| 848 | omega-gliadin | Wheat peptide W19 | Immunogenic | Deamidated | DQ2 | 62 | 16 | GQPPWQPEQPFPQPG |
| 849 | Hordein | Barley peptide B15 | Immunogenic | Native | DQ2 | 62 | 20 | YPQQPFPQQPIPQQPQPY |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 850 | Hordein | Barley peptide B15 | Immunogenic | Native | DQ2 | 62 | 12 | QPQPFPQQPIPQ |
| 851 | hor-3 | Hor-I | Immunogenic | Native | DQ2.5 | 88, 62 | 9 | PIPQQPQPY |
| 852 | hor-3 | Hor-I | Immunogenic | Deamidated | DQ2.5 | 88, 62 | 9 | PIPEQPQPY |
| 853 | Hordein | Barley peptide B16 | Immunogenic | Native | DQ2 | 62 | 20 | QQQPFPQQPIPQQPQYPQQ |
| 854 | Hordein | Barley peptide B16 | Immunogenic | Native | DQ2 | 62 | 11 | QQPFPQQPIPQ |
| 855 | Hordein | Barley peptide B08 | Immunogenic | Deamidated | DQ2 | 62 | 16 | PQQPIPQQPQPYPQQP |
| 856 | Hordein | Barley peptide B08 | Immunogenic | Deamidated | DQ2 | 62 | 16 | PQQPIPEQPQPYPQQP |
| 857 | Hordein | Barley peptide B08 | Immunogenic | Native | DQ2 | 62, 86 | 16 | QPQPIPQQPQPYPQQ |
| 858 | Hordein | Barley peptide B08 | Immunogenic | Deamidated | DQ2 | 62, 86 | 16 | EPQPIPEQPQPYPQQ |
| 859 | Hordein | Hordein core epitope in native form | Immunogenic | Native | DQ2 | 27 | 9 | FPQQPFPQ |
| 860 | Hordein | Hordein core epitope in deaminated form | Immunogenic | Native | DQ2 | 27 | 9 | FPPEQPFPQ |
| 861 | Hordein | Barley peptide B21, 625 | Immunogenic | Native | DQ2 | 62 | 20 | PFPQQPQQPFPQQPQPFRQ |
| 862 | Hordein | Barley peptide B21 | Immunogenic | Deamidated | DQ2 | 62 | 20 | PFPQQPQQPFPQPEQPFRQQ |
| 863 | Hordein | alpha9-Hordein in native form | Immunogenic | Native | DQ2 | 8 | 14 | PQQPFPQQPQQPFRQ |
| 864 | Hordein | alpha9-Hordein in Deamidated form | Immunogenic | Deamidated | DQ2 | 8 | 14 | PQQPFPQPEQPFRQ |
| 865 | Hordein | Barley peptide B21 | Immunogenic | Native | DQ2 | 62 | 13 | QQPFPQQPQPFRQ |
| 866 | Hordein | Barley peptide B21 | Immunogenic | Deamidated | DQ2 | 62 | 13 | QQPFPQPEQPFRQ |
| 867 | hor-1 | Hordein/Secalin | Immunogenic | Native | DQ2.5 | 88, 90, 8, 27, 62 | 9 | PFPQQQPF |
| 868 | hor-1 | Hordein/Secalin | Immunogenic | Deamidated | DQ2.5 | 88, 90, 8, 27, 62 | 9 | PFPQPEQPF |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 869 | Hordein | Barley peptide B22 | Immunogenic | Native | DQ2 | 62 | 20 | PQQPFQPQQPFPQQTIPQQP |
| 870 | Hordein | Barley peptide B22 | Immunogenic | Native | DQ2 | 62 | 12 | QQPFQPQQPFPQ |
| 871 | Hordein | Barley peptide B27 | Immunogenic | Native | DQ2 | 62 | 20 | TFPPSQQPNLPQQPFPLQ |
| 872 | Hordein | Barley peptide B27 | Immunogenic | Native | DQ2 | 62 | 13 | PNPLQPQQPFPLQ |
| 873 | Hordein | Barley peptide B23, 624 | Immunogenic | Native | DQ2 | 62 | 20 | NPLQPQQPFPLQPQPPQQPF |
| 874 | Hordein | Barley peptide B23 | Immunogenic | Native | DQ2 | 62 | 16 | NPLQPQQPFPLQPQPP |
| 875 | Hordein | Barley peptide B24 | Immunogenic | Native | DQ2 | 62 | 16 | PLQPQQPFPLQPQPPQ |
| 876 | Hordein | Barley peptide B10 | Immunogenic | Native | DQ2 | 62 | 20 | PQQQQPFPQQPFSWQPQ |
| 877 | Hordein | Barley peptide B10 | Immunogenic | Deamidated | DQ2 | 62 | 20 | PQQQQPFPQPEQPFSWQPQ |
| 878 | Hordein | Barley peptide B10 | Immunogenic | Native | DQ2 | 62 | 12 | QPFQPQQPFSW |
| 879 | Hordein | Barley peptide B10 | Immunogenic | Deamidated | DQ2 | 62 | 12 | QPFQPEQPFSW |
| 880 | Hordein | Barley peptide B28 | Immunogenic | Native | DQ2 | 62 | 20 | PQQTIPQQPFPLQPQQP |
| 881 | Hordein | Barley peptide B28 | Immunogenic | Native | DQ2 | 62 | 12 | TIPQQPQQPFPL |
| 882 | Hordein | Barley peptide B20 | Immunogenic | Native | DQ2 | 62 | 20 | QQPFPLQQPFPQPQPFPQ |
| 883 | gamma-gliadin | Wheat peptide W26 | Immunogenic | Deamidated | DQ2 | 62 | 16 | GQPFPLQPEQPFPQPG |
| 884 | gamma-gliadin | Wheat peptide W26 | Immunogenic | Deamidated | DQ2 | 62 | 12 | PFPLQPEQPFPQ |
| 885 | gamma-hordein | Barley peptide B07 | Immunogenic | Native | DQ2 | 62 | 20 | QSQQFPQQPFPQQPPQP |
| 886 | gamma-hordein | alpha2-Hordein in native form | Immunogenic | Native | DQ2 | 8 | 14 | QQPFQPQQPFPQQP |
| 887 | gamma-hordein | alpha2-Hordein in Deamidated form | Immunogenic | Deamidated | DQ2 | 8 | 14 | QEFPQQPFPQQP |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 888 | gamma-hordein | alpha2-Hordein in Deamidated form | Immunogenic | Deamidated | DQ2 | 8 | 14 | QQPQPEQPFPQQP |
| 889 | gamma-hordein | alpha2-Hordein in Deamidated form | Immunogenic | Deamidated | DQ2 | 8 | 14 | QEFPQPEQPFPQQP |
| 890 | gamma-hordein | Barley peptide B07 | Immunogenic | Native | DQ2 | 62 | 12 | QQPQPQQPFPQ |
| 891 | hor-2 | Hordein/Secalin | Immunogenic | Native | DQ2.5 | 90, 8, 27 | 9 | PQPQQPFPQ |
| 892 | hor-2 | Hordein/Secalin | Immunogenic | Deamidated | DQ2.5 | 90, 8, 27 | 9 | PQPEQPFPQ |
| 893 | Secalin | Rye peptide R05 | Immunogenic | Deamidated | DQ2 | 62 | 16 | GQPAPIQPEQPFPQQG |
| 894 | Secalin | Rye peptide R05, R26 | Immunogenic | Native | DQ2 | 62 | 20 | PAPIQPQQPFPQQPQQPFPQ |
| 895 | Secalin | Rye peptide R05 | Immunogenic | Deamidated | DQ2 | 62 | 12 | PAPIQPEQPFPQ |
| 896 | Secalin | Rye peptide R05 | Immunogenic | Native | DQ2 | 62 | 12 | PAPIQPQQPFPQ |
| 897 | Secalin | Rye peptide R12 | Immunogenic | Deamidated | DQ2 | 62 | 20 | FPQQPQQPFPQQQLPLQP |
| 898 | Secalin | Rye peptide R12 | Immunogenic | Deamidated | DQ2 | 62 | 16 | GQQPFPQPEQLPLQG |
| 899 | Secalin | Rye peptide R12 | Immunogenic | Native | DQ2 | 62 | 12 | QPFPQPQQQLPL |
| 900 | Secalin | Rye peptide R12 | Immunogenic | Deamidated | DQ2 | 62 | 12 | QPFPQPEQLPL |
| 901 | Secalin | Rye peptide R29 | Immunogenic | Native | DQ2 | 62 | 20 | PTPIQPQQPFPQRPQQPFPQ |
| 902 | Secalin | Rye peptide R29 | Immunogenic | Native | DQ2 | 62 | 12 | PFPQRPQQPFPQ |
| 903 | Secalin | gamma1-Secalin in native form | Immunogenic | Native | DQ2 | 90, 27 | 9 | PQQSFPQQP |
| 904 | Secalin | gamma1-Secalin in Deamidated form | Immunogenic | Deamidated | DQ2 | 90, 27 | 9 | PQQSFPEQP |
| 905 | Secalin | Rye peptide R10 | Immunogenic | Native | DQ2 | 62 | 20 | FPLQPQQPFPQQPEQIISQQ |
| 906 | Secalin | Rye peptide R10 | Immunogenic | Native | DQ2 | 62 | 12 | PFPQQPEQIISQ |
| 907 | Secalin | Rye peptide R25 | Immunogenic | Native | DQ2 | 62 | 20 | FPQQPEQIISQQPQQPFPLQ |
| 908 | Secalin | Rye peptide R25 | Immunogenic | Native | DQ2 | 62 | 15 | PEQIISQQPQPFPL |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 909 | Secalin | Rye peptide R22 | Immunogenic | Native | DQ2 | 62 | 20 | PQQLFPLPQQPFPQPQQPFP |
| 910 | Secalin | Rye peptide R22 | Immunogenic | Native | DQ2 | 62 | 11 | LFPLPQQPFPQ |
| 911 | Secalin | alpha9-Secalin in native form | Immunogenic | Native | DQ2 | 8 | 14 | PQQPFPQPQQPFPQ |
| 912 | Secalin | alpha9-Secalin in Deamidated form | Immunogenic | Deamidated | DQ2 | 8 | 14 | PEQPFPQPQQPFPQ |
| 913 | Secalin | alpha9-Secalin in Deamidated form | Immunogenic | Deamidated | DQ2 | 8 | 14 | PQQPFPQPEQPFPQ |
| 914 | Secalin | alpha2-Secalin in native form | Immunogenic | Native | DQ2 | 8 | 14 | PEQPFPQPEQPFPQ |
| 915 | Secalin | alpha2-Secalin in Deamidated form | Immunogenic | Deamidated | DQ2 | 8 | 14 | QPFPQPQQPFPQSQ |
| 916 | Secalin | alpha2-Secalin in Deamidated form | Immunogenic | Deamidated | DQ2 | 8 | 14 | QPFPQPEQPFPQSQ |
| 917 | gamma-secalin | Rye peptide R21 | Immunogenic | Native | DQ2 | 62 | 20 | NMQVGPSGQVEWPQQQPLPQ |
| 918 | gamma-secalin | Rye peptide R21 | Immunogenic | Native | DQ2 | 62 | 16 | GMQVGPSGQVEWPQQG |
| 919 | gamma-secalin | Rye peptide R21 | Immunogenic | Native | DQ2 | 62 | 12 | QVGPSGQVEWPQ |
| 920 | gamma-secalin | Rye peptide R21 | Immunogenic | Native | DQ2 | 62 | 12 | QVGPSGEVEWPQ |
| 921 | gamma-secalin | Rye peptide R13, R28 | Immunogenic | Native | DQ2 | 62 | 20 | SPQPQQPYPQQPFPQPQQP |
| 922 | gamma-secalin | Rye peptide R13 | Immunogenic | Deamidated | DQ2 | 62 | 16 | GQPEQPYPEQPFPQQG |
| 923 | gamma-secalin | Rye peptide R13 | Immunogenic | Native | DQ2 | 62 | 12 | PQQPYPQQPFPQ |
| 924 | gamma-secalin | Rye peptide R13 | Immunogenic | Deamidated | DQ2 | 62 | 12 | PEQPYPEQPFPQ |
| 925 | gamma-secalin | Rye peptide R23 | Immunogenic | Native | DQ2 | 62 | 20 | PQTQQPQQPFPQQPQQLF |
| 926 | gamma-secalin | Rye peptide R23 | Immunogenic | Native | DQ2 | 62 | 12 | PQTQQPQQPFPQ |
| 927 | gamma-secalin | Rye peptide R27 | Immunogenic | Native | DQ2 | 62 | 20 | PQEPQQLFPQSQQPQQPFPQ |
| 928 | gamma-secalin | Rye peptide R27 | Immunogenic | Native | DQ2 | 62 | 12 | PQSQQPQQPFPQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 929 | gamma-secalin | Rye peptide R17 | Immunogenic | Native | DQ2 | 62 | 20 | QTQQSIPQQPFPQPQQPF QPQQPF |
| 930 | gamma-secalin | Rye peptide R17 | Immunogenic | Native | DQ2 | 62 | 12 | QSIPQPQQPFPQ |
| 931 | gamma-secalin | Rye peptide R02 | Immunogenic | Native | DQ2 | 62 | 20 | SIPQPQQPFPQPQQPFPQSQ |
| 932 | gamma-secalin | Rye peptide R02 | Immunogenic | Deamidated | DQ2 | 62 | 20 | SIPQPQQPFPEQPFPQSQ |
| 933 | gamma-secalin | Rye peptide R02 | Immunogenic | Deamidated | DQ2 | 62 | 16 | GQQPFPQPEQPFPQSG |
| 934 | gamma-secalin | Rye peptide R02 | Immunogenic | Deamidated | DQ2 | 62 | 13 | QPFPQEQPFPQS |
| 935 | gamma-secalin | Rye peptide R02 | Immunogenic | Native | DQ2 | 62 | 12 | QPFPQPQQPFPQ |
| 936 | gamma-secalin | Rye peptide R02 | Immunogenic | Deamidated | DQ2 | 62 | 12 | QPFPQEQPFPQ |
| 937 | omega-Secalin | Rye peptide R07 | Immunogenic | Native | DQ2 | 62 | 20 | QYSPYQPQQPFPQPQQTPI |
| 938 | omega-Secalin | Rye peptide R07 | Immunogenic | Deamidated | DQ2 | 62 | 16 | GQYSPYQPEQPFPQPG |
| 939 | omega-Secalin | Rye peptide R07 | Immunogenic | Native | DQ2 | 62 | 12 | YSPYQPQQPFPQ |
| 940 | omega-Secalin | Rye peptide R07 | Immunogenic | Deamidated | DQ2 | 62 | 12 | YSPYQPEQPFPQ |
| 941 | omega-Secalin | Rye peptide R03 | Immunogenic | Deamidated | DQ2 | 62 | 16 | GQQPFPQPEQPTPIQG |
| 942 | omega-Secalin | Rye peptide R03, R04 | Immunogenic | Native | DQ2 | 62 | 20 | QPFPQPQQPTPIQPQQPFPQ |
| 943 | omega-Secalin | Rye peptide R03 | Immunogenic | Deamidated | DQ2 | 62 | 12 | QPFPQPEQPTPI |
| 944 | omega-Secalin | Rye peptide R03 | Immunogenic | Native | DQ2 | 62 | 12 | QPFPQPQQPTPI |
| 945 | omega-Secalin | Rye peptide R04 | Immunogenic | Deamidated | DQ2 | 62 | 16 | GQPTPIQPEQPFPQQG |
| 946 | omega-Secalin | Rye peptide R04 | Immunogenic | Native | DQ2 | 62 | 12 | PTPIQPQQPFPQ |
| 947 | omega-Secalin | Rye peptide R04 | Immunogenic | Deamidated | DQ2 | 62 | 12 | PTPIQPEQPFPQ |
| 948 | omega-Secalin | Rye peptide R01, R09 | Immunogenic | Native | DQ2 | 62 | 20 | QQLPLQPQQPFPQPQQPIPQ |

TABLE 6-continued

The sequences are, in the order presented, SEQ ID NOs: 1000-2012.

| ID | Type | Description | Form | Toxicity | HLADQ | Refs | SeqLen | Sequence |
|---|---|---|---|---|---|---|---|---|
| 949 | omega-Secalin | Rye peptide R09 | Native | Immunogenic | DQ2 | 62 | 12 | QLPLQPQQPFPQ |
| 950 | omega-Secalin | Rye peptide R01 | Native | Immunogenic | DQ2 | 62 | 12 | QPPFQPQQPIPQ |
| 951 | omega-Secalin | Sec-gammal | Native | Immunogenic | DQ2 | 8 | 14 | PQQQQSFPQQPQR |
| 952 | omega-Secalin | Sec-gammal in Deamidated form | Deamidated | Immunogenic | DQ2 | 8 | 14 | PEQQQSFPQQPQR |
| 953 | omega-Secalin | Sec-gammal in Deamidated form | Deamidated | Immunogenic | DQ2 | 8 | 14 | PQQPEQSFPQQPQR |
| 954 | omega-Secalin | Sec-gammal in Deamidated form | Deamidated | Immunogenic | DQ2 | 8 | 14 | PQQQQSFPEQPQR |
| 955 | omega-Secalin | Sec-gammal in Deamidated form | Deamidated | Immunogenic | DQ2 | 8 | 14 | PEQPEQSFPQQPQR |
| 956 | omega-Secalin | Sec-gammal in Deamidated form | Deamidated | Immunogenic | DQ2 | 8 | 14 | PEQQQSFPEQPQR |
| 957 | omega-Secalin | Sec-gammal in Deamidated form | Deamidated | Immunogenic | DQ2 | 8 | 14 | PQQPEQSFPEQPQR |
| 958 | omega-Secalin | Sec-gammal in Deamidated form | Deamidated | Immunogenic | DQ2 | 8 | 14 | PEQPEQSFPEQPQR |
| 959 | omega-Secalin | Rye peptide R20 | Native | Immunogenic | DQ2 | 62 | 20 | EQIISQQPFPLQPQQPFSQP |
| 960 | omega-Secalin | Rye peptide R20 | Native | Immunogenic | DQ2 | 62 | 12 | PFFLQPQQPFSQ |
| 961 | omega-Secalin | Rye peptide R6 | Native | Immunogenic | DQ2 | 62 | 16 | GQQQPFPQPEQIIG |
| 962 | omega-Secalin | Rye peptide R06, R11, R16 | Native | Immunogenic | DQ2 | 62 | 20 | PQQPFPQQPEQIIPQQPQQP |
| 963 | omega-Secalin | Rye peptide R6 | Native | Immunogenic | DQ2 | 62 | 12 | PQQPFPQQPEQI |
| 964 | omega-Secalin | Rye peptide R6 | Native | Immunogenic | DQ2 | 62 | 12 | PQQPFPEQPEQI |
| 965 | omega-Secalin | Rye peptide R11 | Native | Immunogenic | DQ2 | 62 | 16 | QQPFPQQPQIIPQQP |
| 966 | omega-Secalin | Rye peptide R11 | Deamidated | Immunogenic | DQ2 | 62 | 16 | EQPFPEQPEQIIPQQP |
| 967 | omega-Secalin | Rye peptide R11 | Native | Immunogenic | DQ2 | 62 | 16 | GQPFPQQPQIIPQQG |
| 968 | omega-Secalin | Rye peptide R11 | Deamidated | Immunogenic | DQ2 | 62 | 12 | PFPQQPEQIIPQ |
| 969 | omega-Secalin | Rye peptide R16 | Native | Immunogenic | DQ2 | 62 | 12 | PEQIIPQQPQQP |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 970 | omega-Secalin | Rye peptide R08 | Immunogenic | Native | DQ2 | 62 | 20 | SQQPQRPQQPFPQQPQQIIP |
| 971 | omega-Secalin | Rye peptide R08 | Immunogenic | Native | DQ2 | 62 | 13 | RPQQPFPQQPQQI |
| 972 | omega-Secalin | Rye peptide R15 | Immunogenic | Native | DQ2 | 62 | 20 | QPQQI1PQQPQQPFPLQPQQ |
| 973 | omega-Secalin | Rye peptide R15 | Immunogenic | Native | DQ2 | 62 | 12 | IIPQQPQQPFPL |
| 974 | omega-Secalin | Rye peptide R14, R19 | Immunogenic | Native | DQ2 | 62 | 20 | QQPQQPFPLQPQQPVPQQPQ |
| 975 | omega-Secalin | Rye peptide R14 | Immunogenic | Native | DQ2 | 62 | 16 | QQPQQPFPLQPQQPVP |
| 976 | omega-Secalin | Rye peptide R19 | Immunogenic | Native | DQ2 | 62 | 16 | QPPFPLQPQQPVPQQPQ |
| 977 | omega-Secalin | Rye peptide R18 | Immunogenic | Native | DQ2 | 62 | 20 | QQPFLLQPQQPFSQPQQPFL |
| 978 | omega-Secalin | Rye peptide R18 | Immunogenic | Native | DQ2 | 62 | 11 | FLLQPQQPFSQ |
| 979 | omega-Secalin | Rye peptide R24 | Immunogenic | Native | DQ2 | 62 | 20 | SPQQPQLPFPQPQQPFVVVV |
| 980 | omega-Secalin | Rye peptide R24 | Immunogenic | Deamidated | DQ2 | 62 | 20 | SPQQPQLPFPQPEQPFVVVV |
| 981 | omega-Secalin | Rye peptide R24 | Immunogenic | Native | DQ2 | 62 | 12 | LPFPQPQQPFVV |
| 982 | omega-Secalin | Rye peptide R24 | Immunogenic | Deamidated | DQ2 | 62 | 12 | LPFPQPEQPFVV |
| 983 | gamma-avenin | Av-alpha9B in native form | Immunogenic | Native | DQ2 | 8 | 14 | QYQPYPEQQPFVQ |
| 984 | gamma-avenin | Av-alpha9B in Deamidated form | Immunogenic | Deamidated | DQ2 | 8 | 14 | QYQPYPEQQPFVQ |
| 985 | gamma-avenin | Homolog of oat avenin-derived T cell-stimulatory peptide in Deamidated form | Immunogenic | Deamidated | DQ2 | 62 | 15 | EYQPYPEQPQPILQQ |
| 986 | gamma-avenin | Homolog of oat avenin-derived T cell-stimulatory peptide in native form | Immunogenic | Native | DQ2 | 62 | 15 | QYQPYPQQQPILQQ |
| 987 | ave-1b | gliadin alpha avenin-9 | Immunogenic | Native | DQ2.5 | 90, 18, 8 | 9 | PYPBQQQPF |
| 988 | ave-1b | gliadin alpha avenin-9 | Immunogenic | Deamidated | DQ2.5 | 90, 18, 8 | 9 | PYPEQPF |

TABLE 6-continued

The sequences are, in the order presented, SEQ ID NOs: 1000-2012.

| ID | Type | Description | Toxicity | Form | HLADQ | Refs | SeqLen | Sequence |
|----|------|-------------|----------|------|-------|------|--------|----------|
| 989 | Avenin | T cell recognized Avenin epitope HPLC fraction 9 | Immunogenic | Native | DQ2 | 18 | 31 | TTTVQYDPSEQYQPYPEQQEPFVQQQPPFVQ |
| 990 | Avenin | T cell recognized Avenin epitope HPLC fraction 4 | Immunogenic | Native | DQ2 | 18 | 22 | TTTVQYDPSEQYQPYPEQQEPF |
| 991 | Avenin | T cell recognized Avenin epitope HPLC fraction 9 | Immunogenic | Native | DQ2 | 18 | 28 | TTTVQYNPSEQYQPYPEQQEPFVQQQPF |
| 992 | Avenin | T cell recognized Avenin epitope HPLC fraction 9 | Immunogenic | Native | DQ2 | 18 | 27 | TTTVQYNPSEQYQPYPEQQEPFVQQQPF |
| 993 | Avenin | T cell recognized Avenin epitope HPLC fraction 9 | Immunogenic | Native | DQ2 | 18 | 25 | VQYNPSEQYQPYPEQQEPFVQQQPF |
| 994 | Avenin | T cell recognized Avenin epitope HPLC fraction 3 | Immunogenic | Native | DQ2 | 18 | 22 | TTTVQYNPSEQYQPYPEQQEPF |
| 995 | Avenin | T cell recognized Avenin epitope HPLC fraction 8 | Immunogenic | Native | DQ2 | 18 | 29 | TTTVQYDPSEQYQPYPEQQEPFVQQQPF |
| 996 | Avenin | T cell recognized Avenin epitope HPLC fraction 8 | Immunogenic | Native | DQ2 | 18 | 30 | TTTVQYNPSEQYQPYPEQQEPFVQQQPFV |
| 997 | Avenin | T cell recognized Avenin epitope HPLC fraction 9 | Immunogenic | Native | DQ2 | 18 | 29 | PSEQYQPYPEQQEPFVQQQPFVQQQPF |
| 998 | Avenin | Avenin 1490 in native form | Immunogenic | Native | DQ2 | 18 | 19 | SEQYQPYPEQQEPFVQQQQ |
| 999 | Avenin | Avenin 1490 in Deamidated form | Immunogenic | Deamidated | DQ2 | 18 | 19 | SEQYQPYPEEEPFVQQQQ |
| 1000 | Avenin | Av-alpha9A in native form | Immunogenic | Native | DQ2 | 8 | 14 | QYQPYPEQQEPFVQ |
| 1001 | Avenin | Av-alpha9A in Deamidated form | Immunogenic | Deamidated | DQ2 | 8 | 14 | QYQPYPEQEEPFVQ |
| 1002 | Avenin | Avenin 1505 | Immunogenic | Native | DQ2 | 18 | 12 | YQPYPEQQEPFV |
| 1003 | Avenin | Avenin 1504 (deamidated form of Avenin 1505) | Immunogenic | Deamidated | DQ2 | 18 | 12 | YQPYPEQEEPFV |
| 1004 | ave-1 | gliadin alpha avenin-9 | Immunogenic | Native | DQ2.5 | 90, 18, 8 | 9 | PYPEQQEPF |
| 1005 | ave-1 | gliadin alpha avenin-9 | Immunogenic | Deamidated | DQ2.5 | 90, 18, 8 | 9 | PYPQEEPF |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 1006 | Avenin | Av-gamma2B | Immunogenic | Native | DQ2 | 8 | 14 | QQPFVQQQQPFVQQ |
| 1007 | Avenin | Av-gamma2B in Deamidated form | Immunogenic | Deamidated | DQ2 | 8 | 14 | EQPFVQQQQPFVQQ |
| 1008 | Avenin | Av-gamma2B in Deamidated form | Immunogenic | Deamidated | DQ2 | 8 | 14 | QQPFVEQQQPFVQQ |
| 1009 | Avenin | Av-gamma2B in Deamidated form | Immunogenic | Deamidated | DQ2 | 8 | 14 | EQPFVEQQQPFVQQ |
| 1010 | Avenin | Av-gamma2B in Deamidated form | Immunogenic | Deamidated | DQ2 | 8 | 14 | QQPFVQEQQPFVQQ |
| 1011 | Avenin | Av-gamma2B in Deamidated form | Immunogenic | Deamidated | DQ2 | 8 | 14 | EQPFVQEQQPFVQQ |
| 1012 | Avenin | Av-gamma2B in Deamidated form | Immunogenic | Deamidated | DQ2 | 8 | 14 | QQPFVEEQQPFVQQ |
| 1013 | Avenin | Av-gamma2B in Deamidated form | Immunogenic | Deamidated | DQ2 | 8 | 14 | EQPFVEEQQPFVQQ |
| 1014 | Avenin | Av-gamma2B in Deamidated form | Immunogenic | Deamidated | DQ2 | 8 | 14 | QQPFVQQEQPFVQQ |
| 1015 | Avenin | Av-gamma2B in Deamidated form | Immunogenic | Deamidated | DQ2 | 8 | 14 | EQPFVQQEQPFVQQ |
| 1016 | Avenin | Av-gamma2B in Deamidated form | Immunogenic | Deamidated | DQ2 | 8 | 14 | QQPFVEQEQPFVQQ |
| 1017 | Avenin | Av-gamma2B in Deamidated form | Immunogenic | Deamidated | DQ2 | 8 | 14 | EQPFVEQEQPFVQQ |
| 1018 | Avenin | Av-gamma2B in Deamidated form | Immunogenic | Deamidated | DQ2 | 8 | 14 | QQPFVQEEQPFVQQ |
| 1019 | Avenin | Av-gamma2B in Deamidated form | Immunogenic | Deamidated | DQ2 | 8 | 14 | EQPFVQEEQPFVQQ |
| 1020 | Avenin | Av-gamma2B in Deamidated form | Immunogenic | Deamidated | DQ2 | 8 | 14 | QQPFVEEEQPFVQQ |
| 1021 | Avenin | Av-gamma2B in Deamidated form | Immunogenic | Deamidated | DQ2 | 8 | 14 | EQPFVEEEQPFVQQ |
| 1022 | Avenin | Avenin core epitope in native form | Immunogenic | Native | DQ2 | 27 | 9 | FVQQQQPF |
| 1023 | Avenin | Avenin core epitope in Deamidated form | Immunogenic | Deamidated | DQ2 | 27 | 9 | FVQQEQPF |
| 1024 | gamma-gliadin or LMW glutenin | Glu-21 minimal epitope in considered native form | Immunogenic | Native | DQ2 | 19 | 12 | QSEQSQQPQPQ |
| 1025 | glia-gamma 3, glia-gamma 1b | gamma gliadin | Immunogenic | Deamidated | DQ2.5 or DQ8 | 90, 17, 23 | 9 | EQPQQPYPQ |
| 1026 | glia-gamma 3, glia-gamma 1b | gamma gliadin | Immunogenic | Deamidated | DQ2.5 or DQ8 | 90, 17, 23 | 9 | QQPQQPYPE |
| 1027 | glia-gamma 3, glia-gamma 1b | gamma gliadin | Immunogenic | Deamidated | DQ2.5 or DQ8 | 90, 78, 23 | 9 | EQPEQPYPQ |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 1028 | glia-gamma 3, glia-gamma 1b | CAUTION, 100% match to Candida protein/gamma | Immunogenic | Deamidated | DQ2.5 or DQ8 | 90, 78, 23 | 9 | QQPEQPYPE |
| 1029 | glia-gamma 3 | gamma 5 gliadin | Immunogenic | Deamidated | DQ2.5 | 90, 78, 23 | 9 | SQPEQQFPQ |
| 1030 | glia-gamma 3 | gamma 5 gliadin | Immunogenic | Deamidated | DQ2.5 | 90, 78, 23 | 9 | SQPQQEFPQ |
| 1031 | glia-gamma 1b, glia-gamma 4c | gammaVII-gliadin | Immunogenic | Deamidated | DQ2.5 | 90, 17, 25 | 9 | QQPQQPFPE |
| 1032 | glia-gamma c, glia-gamma 1b | gammaVII-gliadin | Immunogenic | Deamidated | DQ2.5 | 90, 17, 25, 8 | 9 | QQPEQPFPE |
| 1033 | glia-gamma 4c, glia-gamma 1b | gammaVII-gliadin | Immunogenic | Deamidated | DQ2.5 | 90, 17, 25 | 9 | EQPEQPFPE |
| 1034 | glia-gamma 4c | gamma gliadin | Immunogenic | Native | DQ2.5 | 90, 62, 78, 81 | 9 | PQPQQPFCQ |
| 1035 | glia-gamma 4d | gamma gliadin | Immunogenic | Deamidated | DQ2.5 | 90, 62, 78, 81 | 9 | PQPEQPFCQ |
| 1036 | glia-gamma 4d | gamma gliadin | Immunogenic | Deamidated | DQ2.5 | 90, 62, 78, 81 | 9 | PQPQQPFCE |
| 1037 | glia-gamma 4d | gamma gliadin | Immunogenic | Deamidated | DQ2.5 | 90, 62, 78, 81 | 9 | PQPEQPFCE |
| 1038 | glia-gamma 4e | gliadin omega 1 | Immunogenic | Native | DQ2.5 | 90, 86 | 9 | PQPQQPFSQ |
| 1039 | glia-gamma 4e | gliadin omega 1 | Immunogenic | Deamidated | DQ2.5 | 90, 86 | 9 | PQPEQPFSQ |
| 1040 | glia-omega 3 | gliadin omega 3 | Immunogenic | Native | DQ2.5 | 86, 90 | 9 | PFPQPQQPI |
| 1041 | glia-omega 3 | gliadin omega 3 | Immunogenic | Deamidated | DQ2.5 | 86, 90 | 9 | PFPQPEQPI |
| 1042 | glia-omega 4 | CAUTION 100% match to 2 Prunus sp. peptides/gliadin omega 4 | Immunogenic | Native | DQ2.5 | 86, 90 | 9 | PQPQQPIPV |
| 1043 | glia-omega 4 | gliadin omega 4 | Immunogenic | Deamidated | DQ2.5 | 86, 90 | 9 | PQPEQPIPV |
| 1044 | glia-omega 5 | gliadin omega 5 | Immunogenic | Native | DQ2.5 | 86, 90 | 9 | LQPQQPFPQ |
| 1045 | glia-omega 5 | gliadin omega 5 | Immunogenic | Deamidated | DQ2.5 | 86, 90 | 9 | LQPEQPFPQ |
| 1046 | Avenin Q | avenin-gliadin like | Immunogenic | Native | DQ2 or DQ8 | 87 | 14 | QQPFMQQQPFMQP |

TABLE 6-continued

The sequences are, in the order presented, SEQ ID NOs: 1000-2012.

| ID | Type | Description | Toxicity | Form | HLADQ | Refs | SeqLen | Sequence |
|---|---|---|---|---|---|---|---|---|
| 1047 | Avenin Q-5 | avenin-gliadin like | Immunogenic | Native | DQ2 or DQ8 | 88 | 14 | QQPFVQQQQPFVQ |
| 1048 | glia-gamma 1 | gamma gliadin 1 | Immunogenic | Deamidated | DQ2.5 | 90, 74 | 9 | PEQSFPQQQ |
| 1049 | glia-gamma 1 | gamma gliadin | Immunogenic | Deamidated | DQ2.5 | 90, 74 | 9 | PEQSFPQQE |
| 1050 | ave-1 06 | Avenin gliadin like | Immunogenic | Native | DQ2.5 | 88 | 16 | QYQPYPEQQQPILQQQ |
| 1051 | ave-1 06 | avenin-gliadin like | Immunogenic | Deamidated | DQ2.5 | 88 | 16 | QYQPYPEQEQPILQQQ |
| 1052 | ave-1 04 | avenin-gliadin like | Immunogenic | Native | DQ2.5 | 88 | 16 | QQYQPYPQQQPFMQPL |
| 1053 | ave-1 04 | avenin-gliadin like | Immunogenic | Deamidated | DQ2.5 | 88 | 16 | EQYQPYPEQQPFMQPL |

CD1D multimer and ligand:

CD1D Multimer and Ligand:

In one embodiment, the peptide is a human, non-human, or synthetic/engineered peptide. For example, the peptide is a Minor Histocompatibility Antigen (MiHA).

Exemplary MiHAs are known in the art, e.g., in Spierings et al. Tissue Antigens 2014 84:347-360; which is incorporated by reference herein. MiHAs are typically utilized in embodiments relating to transplantation, where it refers to epitopes that are created because of protein sequence variation in polymorphic proteins.

Residues of the antigenic peptide that engages the MHC binding groove can loosely be divided into two types: anchor residues, which engage with the MHC molecule and confer stability to the MHC-peptide complex (for example, see residues P2, P3, P5, P6, P7, and P9 in Bowness et al. 1999 Expert Reviews in Molecular Medicine 16:1-10; which is incorporated by reference herein in its entirety), and interfacial residues, which are solvent-exposed and can engage with the cognate T-cell receptor (see, e.g., residues P1, P4, and P8 in Bowness). A featureless peptide is a peptide in which anchor residues are preserved, while interfacial residues of the peptide are mutated to alanine or glycine residues to prevent TCR binding A featureless peptide-MHC is therefore a MHC peptide complex in which the presented peptide is a featureless peptide. Featureless peptide MHCs are typically used in embodiments relating to transplantation tolerance. In patients receiving MHC-mismatched solid organ or hematopoietic stem cell transplants, use of a CAL T cell presenting the relevant donor-mismatched featureless peptide-MHC CAL can permit selective depletion of recipient alloreactive T cells targeted towards this mismatched donor HLA allele.

The MHC can be a monomer, dimer, trimer, tetramer, pentamer, dextramer or other oligomer form. In embodiments where more than one MHC unit is present, e.g., the MHC is oligomeric, the units can be provided in series, e.g., in a chain, or provided arrayed in one or more dimensions around a central point or linker, provided conjugated/bound in any geometry to a scaffold molecule, or any combination of the foregoing. Naturally occurring examples of TCR recognition domain structures in the art include MHC dimers (Lebowitz et al., 1999 Cellular Immunology 192: 175-184), tetramers (Altman et al., 1996 Science 274:94-96), pentamers (proimmune.com/introduction-to-pentamers/), octamers (Guillame et al., 2003 JBC 278:4500-4509), dextramers (Batard et al., 2006 Journal of Immunological Methods 310:136-148), dodecamers (Huang et al., 2016 PNAS 113:E1890-7), lipid vesicles (Mallet-Designe et al., 2003 The Journal of Immunology 170:123-131), and quantum dots (Chattopadhyay et al., 2006 Nature Medicine 12:972-7). Each of the foregoing references is incorporated by reference herein in its entirety.

In some embodiments, the TCR recognition domain can comprise a CD1 domain (e.g., a CD1d domain), e.g., a sequence comprising an extracellular domain of CD1, (e.g., CD1). As used herein, "cluster of differentiation 1 family member d" or "CD1d" refers to a cell surface protein that displays lipid antigens to T cells. The sequences of several CD1d isoforms, and the structure of CD1d are known in the art, see, e.g., the 3 isoforms provided in the NCBI database for CD1d (Gene ID 912), and Bagchi et al., 2018 and Oleinika et al., Nature Communications 2018 9:684; which are incorporated by reference herein in their entireties. For example, isoform 1 of CD1d is SEQ ID NO: 5 (NCBI Ref Seq NP_001757.1), isoform 2 of CD1d is SEQ ID NO: 6 (NCBI Ref Seq NP_001306074.1), and isoform 3 of CD1d is SEQ ID NO: 7 (NCBI Ref Seq NP_001358690.1). In some embodiments, the CD1d domain comprises a sequence with at least 80%, at least 85%, at least 90%, at least 95%, at least 98% or greater sequence identity to one of SEQ ID NOs: 5-7. In some embodiments, the CD1d domain comprises a sequence with at least 80%, at least 85%, at least 90%, at least 95%, at least 98% or greater sequence identity to the extracellular domain of one of SEQ ID NOs: 5-7 (e.g., amino acids 20-301 of SEQ ID NO: 5). In some embodiments, the CD1d domain comprises a sequence with at least at least 95% sequence identity to one of SEQ ID NOs: 5-7 and retains the lipid binding activity of the wild-type reference sequence. In some embodiments, the CD1d domain comprises a sequence with at least 95% sequence identity to the extracellular domain of one of SEQ ID NOs: 5-7 (e.g., amino acids 20-301 of SEQ ID NO: 5) and retains the lipid binding activity of the wild-type reference sequence.

In some embodiments, the CD1 domain further comprises a ligand, e.g., a non-peptide ligand. Exemplary, non-limiting ligands of CD1 domains include but are not limited to:

| Protein (Allele) | Ligand |
|---|---|
| human CD1a | C-glycoside |
|  | GSL-1 |
|  | OCH |
| human CD1b | C-glycoside |
|  | GSL-1 |
|  | OCH |
| human CD1c | C-glycoside |
|  | GSL-1 |
|  | OCH |
| human CD1d | OCH |
| human CD1d | PBS-57 |

In some embodiments, a TCR recognition domain can comprise sequences or molecules in addition to the, e.g., MHC, pMHC, of CD1 domains and sequences. For example, it can further comprise other polypeptide and/or non-polypeptide components that enable multimerization. Exemplary components that permit multimerization can include biotin (non-polypeptide) and/or streptavidin polypeptide that is used to permit tetramerization.

In various embodiments, protein interaction domains are found on an extracellular portion of the respective polypeptides.

As used herein, "recognition polypeptide" refers to an extracellular polypeptide having a ligand-binding domain. In some embodiments, the ligand-binding domain can be an antibody reagent. In some embodiments, the recognition polypeptide can further comprise a protein interaction domain.

As used herein, "signaling polypeptide" refers to a transmembrane polypeptide having an intracellular signaling domain, e.g., a T cell receptor (TCR) signaling domain. In some embodiments, the signaling polypeptide can further comprise a protein interaction domain. In some embodiments, the signaling polypeptide can further comprise an extracellular protein interaction domain.

As used herein, "biomolecular interaction domain" refers to a domain that permits specific binding of two separate molecules to each other. The molecules can be or can comprise polypeptides. In some embodiments, one or both of the molecules or biomolecular interaction domains can be a non-peptide. When a pair of biomolecular interaction domains is provided herein, they permit two or more molecules to bind specifically, e.g. one of the biomolecular interaction domains can bind specifically to the second biomolecular interaction domain. In some embodiments, specific binding can occur when two separate biomolecular interaction domains, e.g., of a pair, are present. In some embodiments, specific binding can occur when three or more separate biomolecular interaction domains are present. It is noted that protein interaction domains are a type of biomolecular interaction domains and where one is specified herein, the other may always be substituted.

As used herein, when a molecule is referred to as a protein or polypeptide, it comprises a protein, peptide, or polypeptide sequence, but may comprise additional motifs, modifications, or domains of a non-proteinaceous nature. A number of exemplary biomolecular interaction domains, as well as pairs of protein interaction domains are provided elsewhere herein. In some embodiments, the biomolecular interaction domains comprise, consist, or consist essentially of proteins or polypeptides. In some embodiments, the biomolecular interaction domains comprise, consist, or consist essentially of non-proteinaceous molecules. In some embodiments, one of a pair of biomolecular interaction domains can comprise, consist, or consist essentially of proteins or polypeptides and the second of the pair of biomolecular interactions domains can comprise, consist, or consist essentially of a non-proteinaceous molecule (e.g., FITC and anti-FITC). Exemplary protein interaction domains are known in the art and can be used in embodiments of the aspects described herein.

As used herein, "protein interaction domain" refers to a domain that permits specific binding of two separate polypeptides to each other. A number of exemplary protein interaction domains, as well as pairs of protein interaction domains are provided elsewhere herein. In some embodiments, the protein interaction domains of the polypeptides of a multi-component CAL and/or CAR can bind specifically, e.g. one of the protein interaction domains can bind specifically to a second protein interaction domain of the multi-component CAL and/or CAR. In some embodiments, specific binding can occur when two separate protein interaction domains are present. In some embodiments, specific binding can occur when three or more separate protein interaction domains are present. Exemplary protein interaction domains are known in the art and can be used in embodiments of the aspects described herein.

In some embodiments of any of the aspects described herein, the protein interaction domains can be leucine zipper domains. Leucine zipper domains are a type of protein-protein interaction domain commonly found in transcription factors characterized by leucine residues evenly spaced through a α-helix. Leucine zippers may form heterodimers or homodimers. A number of leucine zipper domains, as well as their ability to bind each other, are known in the art and discussed further, e.g., in Reinke et al. JACS 2010 132: 6025-31 and Thompson et al. ACS Synth Biol 2012 1:118-129; each of which is incorporated by reference herein in its entirety. In some embodiments, one leucine zipper domain is BZip (RR) and the second leucine zipper domain is AZip (EE). In some embodiments, the sequence of a BZip (RR) leucine zipper domain is MDPDLEIRAAFLRQRNTA-LRTEVAELEQEVQRLENEVSQYETRYGPLGGGK (SEQ ID NO: 3). In some embodiments, the sequence of a AZip (EE) leucine zipper domain is MDPDLEIEAAFLER-ENTALETRVAELRQRVQRLRNRVSQYRTRYG-PLGGGK (SEQ ID NO: 4). Further exemplary leucine zipper domains are described in Reinke et al. JACS 2010 132:6025-31; which is incorporated by reference herein in its entirety. For example, suitable leucine zipper domains can include SYNZIP1 to SYNZIP48, and BATF, FOS, ATF4, ATF3, BACH1, JUND, NFE2L3, and HEPTAD. Binding affinities of various combinations of these domains are described, e.g., at FIG. 1 of Reinke et al. In some embodiments, a suitable pair of leucine zipper domains has a dissociation constant (Kd) of 1000 nM or less. In some embodiments, a suitable pair of leucine zipper domains has a dissociation constant (Kd) of 100 nM or less. In some embodiments, a suitable pair of leucine zipper domains has a dissociation constant (Kd) of 10 nM or less. In some embodiments, a suitable pair of leucine zipper domains has a dissociation constant (Kd) of 1 nM or less.

Further exemplary pairs of protein interaction domains can include a) PSD95-Dlg1-zo-1 (PDZ) domains; b) a streptavidin domain and a streptavidin binding protein (SBP) domain; and c) a PYL domain and an ABI domain.

In some embodiments of any of the aspects described herein, the protein interaction domains can be chemically-induced protein interaction domains, e.g., domains that will only bind specifically in the presence of a third molecule, e.g., a small molecule or drug. Exemplary pairs of chemically-induced protein interaction domains can include: FKBP-binding domain of mTOR (FRB) and FK506 binding protein (FKBP) (binding of which is activated by tacrolimus, everolimus, or a rapalog); cyclophilin-Fas fusion protein (CyP-Fas) and FK506 binding protein (FKBP) (binding of which is activated by FKCsA); calcineurin A (CNA) and FK506 binding protein (FKBP) (binding of which is activated by FK506); gibberellin insensitive (GIA) and gibberellin insensitive dwarf1 (GID1) (binding of which is activated by gibberellin); Snap-tag and Halo tag (binding of which is activated by HaXS); and T14-3-3-cdeltaC and C-Terminal peptides of PMA2 (CT52) (binding of which is activated by fusicoccin). Further description of chemically-induced protein interaction domains can be found in the art, e.g., Miyamoto et al. Nat Chem Biol. 2012 Mar. 25; 8(5): 465-470 and Belshaw et al. PNAS 1996 93:4604-4607; each of which is incorporated herein by reference in its entirety.

In some embodiments of any of the aspects described herein, the protein interaction domains can comprise at least one nucleotide tag and at least one zinc finger domain. Zinc finger domains are characterized by the coordination of a zinc ion in order to stabilize their tertiary structure. The particular folds that appear in zinc fingers can vary. In some embodiments, a zinc finger domain can be a nucleotide-binding zinc finger domain. In some embodiments, a zinc finger domain can be a DNA-binding zinc finger domain. In some embodiments, the protein interaction domain of the recognition polypeptide is a nucleotide tag and the extracellular protein interaction domain of the signaling polypeptide is a zinc finger domain. In some embodiments, a nucleotide tag can be a DNA tag. In some embodiments, a nucleotide tag can be a dsDNA tag comprising the entire recognition sequence for the zinc finger domain being used. Exemplary zinc finger domains and their cognate nucleotide tags are described in the art, e.g. Mali et al. Nature Methods 2013 10:403-406; which is incorporated by reference herein in its entirety. In some embodiments, a zinc finger domain can be sZF15 as described in Mali et al. Nature Methods 2013 10:403-406.

In one embodiment, the protein interaction domain(s) is a BZip (RR) and/or a AZip (EE), or any binding pair of protein interaction domains are collectively a BZip (RR) and a AZip (EE).

In some embodiments of any of the aspects described herein, the protein interaction domains can comprise a pair of substantially complementary nucleotide tags, e.g., fully complementary or complementary enough to hybridize specifically. The degree of complementarity necessary may vary depending on the total length of the tags and G/C content of the complementary portions. One of skill in the art can readily determine the relevant affinity necessary for tags of a given size and G/C content. In some embodiments, a nucleotide tag can be a DNA tag.

In some embodiments, a nucleotide tag can be a DNA tag. In some embodiments, a nucleotide tag can be a dsDNA tag.

In one embodiment, the protein interaction domain(s) is a gibberellin insensitive (GIA) and/or a gibberellin insensitive dwarf1 (GID1) or any binding pair of protein interaction domains are collectively a gibberellin insensitive (GIA) and a gibberellin insensitive dwarf1 (GID1).

In one embodiment, the protein interaction domain(s) is a Snap-tag and/or a Halo tag, or any binding pair of protein interaction domains are collectively a Snap-tag and a Halo tag.

In one embodiment, the protein interaction domain(s) is a T14-3-3-cdeltaC and/or a C-Terminal peptides of PMA2 (CT52), or any binding pair of protein interaction domains are collectively a T14-3-3-cdeltaC and a C-Terminal peptides of PMA2 (CT52).

In one embodiment, the protein interaction domain(s) is a PYL and/or a ABI, or any binding pair of protein interaction domains are collectively a PYL and a ABI.

In one embodiment, the biomolecular interaction domain(s) is a Fluorescein isothiocyanate (FITC) and/or a FITC binding protein or any binding pair of biomolecular interaction domains are collectively a FITC and a FITC binding protein.

In one embodiment, the biomolecular interaction domain(s) is a (R)-Phycoerythrin (R-PE/PE) and/or a R-PE/PE binding protein or any binding pair of biomolecular interaction domains are collectively a (R)-Phycoerythrin (R-PE/PE) and/or a R-PE/PE binding protein.

In some embodiments, the biomolecular domain on the molecule comprising a TCR recognition domain and biomolecular interaction domain (i.e. a CAL) binds specifically to a native cell surface molecule on a NK cell, dendritic cell, or T cell. In such embodiments, a subject can be treated as described herein without administration of an engineered cell. In some embodiments, the biomolecular domain on the molecule comprising a TCR recognition domain and biomolecular interaction domain (i.e. a CAL) binds specifically to a native cell surface molecule on a NK cell. In some embodiments, the biomolecular domain on the molecule comprising a TCR recognition domain and biomolecular interaction domain (i.e. a CAL) binds specifically to a native cell surface molecule on dendritic cell. Exemplary native cell surface molecules for such embodiments include, but are not limited to CD3. Other suitable cell surface molecules are the CD cell surface proteins. CDs are known in the art and one of ordinary skill can readily select one expressed by the desired cell type(s). For example, see the HCDM database at hcdm.org and the lists available on the world wide web at chemeurope.com/en/encyclopedia/List_of_human_clusters_of differentiation.html; and docs.abcam.com/pdf/immunology/Guide-to-human-CD-antigens.pdf. Accordingly, exemplary biomolecular interaction domains for such embodiments include but are not limited to an anti-CD3 antibody reagent, or a Fab domain. One of skill in the art is aware of other cell surface molecules found, or found exclusively, on the cell surface of the relevant cell type(s), as well as multiple reagents that can bind (e.g., bind specifically) to such cell surface molecules.

In aspects with a single recognition polypeptide and a single signaling polypeptide that are able to bind specifically without a third polypeptide, the multiple-component CALs or CARS described herein will activate in the presence of the target ligand, thereby inducing T cell activity in the vicinity of the target ligand. Further described herein are multiple-component CALs or CARs capable of logic computation, for example, multiple-component CALs or CARs that serve as AND, OR, or NOT logic gates.

In some aspects, described herein are compositions that comprise components of a multi-component CAL and/or CAR that permits AND gate logic. In these aspects, activation of the multi-component CAL and/or CAR happens only in the presence of two target ligands; recognition of a single target ligand is not sufficient for activation. Such multi-component CALs or CARS can permit greater specificity and reduce off-target effects. Any single ligand that is a good marker for a target cell or tissue may occur elsewhere in a subject, resulting in off-target effects. However, requiring the recognition of two separate marker ligands reduces the odds of off-target activity.

In one embodiment, a nucleotide tag can be a DNA tag or dsDNA tag.

Further embodiments of AND logic gate multi-component CALs and CARs are described herein.

In some embodiments of any of the aspects described herein, the compositions comprise components of a multi-component CAL and/or CAR that are NOT logic gate. For example, recognition of a second target ligand by a second recognition polypeptide can prevent interaction (e.g. specific binding) of the signaling polypeptide and first recognition polypeptide. Such embodiments can permit suppression of T cell activity in inappropriate and/or off-target tissues. For example, the second target ligand can be a marker of a tissue that is particularly sensitive to T cell activity, is a known area of off-target activity, and/or shares markers with the desired target tissue. In some embodiments, in a NOT gate multi-component CAL and/or CAR, the second target ligand is not a ligand found in the target tissue and/or cells, e.g., in or on a disease T cell. In some embodiments, the second target ligand of a NOT logic gate multi-component CAL and/or CAR is found on a healthy and/or non-target cell and not on a diseased and/or target cell. Various 2- and 3-dimensional configurations of such pairs of nucleotide pairs are known in the art.

In some embodiments, the target ligand recognized by the second recognition polypeptide is found on a healthy and/or non-target cell and not on a diseased and/or target cell. In some embodiments, the protein interaction domain of the second recognition polypeptide and the protein interaction domain of the first recognition polypeptide have a greater affinity than the protein interaction domain of the signaling polypeptide and the protein interaction domain of the first recognition polypeptide. In some embodiments, the protein interaction domain of the second recognition polypeptide and the protein interaction domain of the signaling polypeptide have a greater affinity than the protein interaction domain of the signaling polypeptide and the protein interaction domain of the first recognition polypeptide. Relative binding affinities can be determined experimentally, e.g., by binding affinity assays known in the art and relative binding affinities are known for a number of combinations of protein interaction domains described herein, see, e.g. Reinke et al. JACS 2010 132:6025-31; which is incorporated by reference herein in its entirety. In some embodiments, the binding affinity of the recognition polypeptide protein interaction domains can be at least 2× greater than the binding affinity of the first recognition polypeptide protein interaction domain and the signaling polypeptide interaction domain. In some embodiments, the binding affinity of the recognition polypeptide protein interaction domains can be at least 5× greater than the binding affinity of the first recognition polypeptide protein interaction domain and the signaling polypeptide interaction domain. In some embodiments, the binding affinity of the recognition polypeptide protein interaction domains can be at least 10× greater than the binding affinity of the first recognition polypeptide protein interaction domain and the signaling polypeptide interaction domain.

As used herein, "target ligand" refers to a molecule in or on a cell which can be bound by a ligand-binding domain. Non-limiting examples of such molecules can include polypeptides, lipids, saccharides, and the like. In some embodiments, the target ligand can be an extracellular molecule. In some embodiments, the target ligand can be a cell surface molecule.

In some embodiments, e.g., those relating to a multi-component CAL and/or CAR with a single recognition polypeptide or an AND gate multi-component CAL and/or CAR, the target ligand (e.g. the first and/or second target ligand) can be a ligand expressed in a target tissue. In some embodiments, the target ligand can be expressed constitutively in the target tissue and/or cell. In some embodiments, the target ligand can be expressed exclusively in the target tissue and/or cell. In some embodiments, the target ligand can be expressed at a higher level in the target tissue and/or cell than in other tissues and/or cells. As recognition of a target ligand in embodiments relating to a multi-component CAL and/or CAR with a single recognition polypeptide or an AND gate multi-component CAL and/or CAR can result in T cell activation (e.g. cell killing activity of the cell comprising the target ligand), the target ligand can be selected to target T cell activity in a desirable and/or therapeutic way, e.g., by targeting a disease cell. In some embodiments, a target ligand is a ligand found in/on a diseased and/or target cell. In some embodiments, the target ligand specifically bound by a recognition polypeptide that can specifically bind with a signaling polypeptide or is a portion of an AND gate multi-component CAL and/or CAR is a ligand found in/on a diseased and/or target cell. In some embodiments, a target ligand specifically bound by a recognition polypeptide that can specifically bind with a signaling polypeptide or is a portion of an AND gate multi-component CAL and/or CAR is a ligand found on a diseased and/or target cell and not on a healthy and/or non-target cell. In some embodiments, the diseased cell is an autoreactive or alloreactive T cell. In some embodiments, the target ligand specifically bound by a recognition polypeptide that can specifically bind with a signaling polypeptide or is a portion of an AND gate multi-component CAL and/or CAR is found on the surface of a disease cell. In some embodiments, a recognition polypeptide that can specifically bind with a signaling polypeptide or is a portion of an AND gate multi-component CAL and/or CAR specifically binds to a target ligand on the surface of a disease cell, e.g. as compared to binding to normal cells.

In some embodiments, a composition and/or cell described herein can further comprise a second multi-component CAL and/or CAR according to any of the aspects and embodiment described herein for the first multi-component CAL and/or CAR. By way of non-limiting example, a second CAL and/or CAR can be designed to bind specifically to (and, e.g., be activated by or inhibited by) different target ligands than those to which the first multi-component CAL and/or CAR specifically binds (and, e.g. is activated by or inhibited by). This can provide increased specificity, reduced off-target effects, and/or reduced effective dosages for the methods described herein. In some embodiments, the recognition domain of second multi-component CAL and/or CAR bind specifically to different target ligands than those bound by the recognition domain of the first multi-component CAL and/or CAR. In some embodiments, the antibody reagents of second multi-component CAL and/or CAR bind specifically to different target ligands than those bound by the antibody reagents of the first multi-component CAL and/or CAR.

In some embodiments, the second multi-component CAL and/or CAR can comprise an inhibitory intracellular signaling domain, e.g., T cell receptor (TCR) signaling domain, e.g., one that inhibits engineered cell, e.g., T cell, activity. In such embodiments, the second multi-component can therefore be designed to operate in opposition to the first multi-component CAL and/or CAR, e.g. permitting inhibition of T cell activation while the first multi-component CAL and/or CAR permits activation of T cell activity. Inhibitory intracellular TCR signaling domains are known in the art and can include, by way of non-limiting example, PD1; CTLA4; BTLA; KIR; LAG-3; TIM-3; A2aR; LAIR-1; and TGIT. In one embodiment, non-active mimetics of an activating TCR can be used.

In some embodiments, described herein is a composition comprising a cell, a CAL, and a CAR (e.g., with the CAR comprising either an inhibitory domain or costimulation/activation domain).

In one embodiment, the TCR recognition domain comprises a MHC allogeneic to the cell. In one embodiment, the TCR recognition domain comprises a peptide allogeneic to the cell. In one embodiment, the TCR recognition domain comprises a MHC allogeneic to the target cell. In one embodiment, the TCR recognition domain comprises a peptide allogeneic to the target cell. In one embodiment, the TCR recognition domain comprises a non-self peptide relative to the target cell.

In some embodiments, the target ligand specifically bound by a recognition polypeptide that can specifically bind with the signaling polypeptide of the second multi-component CAL and/or CAR comprising an inhibitory intracellular signaling domain is a ligand found on a healthy and/or non-target cell. In some embodiments, the target ligand specifically bound by a recognition polypeptide that can specifically bind with the signaling polypeptide of the second multi-component CAL and/or CAR comprising an inhibitory intracellular signaling domain is a ligand found on a healthy and/or non-target cell and not on a diseased and/or target cell. In some embodiments, the second multi-component CAL and/or CAR comprising an inhibitory intracellular signaling domain can be an OR logic gate according to any of the embodiments described herein and the second target ligand can be a ligand found in/on, or specific to, diseased cells.

In some embodiments of any of the aspects, a ligand-binding domain can comprise or consist essentially of an antibody reagent. In some embodiments, the antibody reagent can be an immunoglobulin molecule, a monoclonal antibody, a chimeric antibody, a CDR-grafted antibody, a human antibody, a humanized antibody, a Fab, a Fab', a F(ab')2, a Fv, a disulfide linked Fv, a scFv, a single domain antibody, a diabody, a multispecific antibody, a dual specific antibody, an anti-idiotypic antibody, and/or a bispecific antibody.

In some embodiments, the intracellular signaling domain can be a T-cell activation domain. In some embodiments, the intracellular signaling domain is a signaling domain from a protein selected from the group consisting of: TCRζ, FcRγ, FcRβ, CD3γ, CD3δ, CD3ε, CD3λ, CD22, CD79a, CD79b, CD66d, CARD11, CD2, CD7, CD27, CD28, CD30, CD40, CD54 (ICAM), CD83, CD134 (OX40), CD137 (4-1BB), CD150 (SLAMF1), CD152 (CTLA4), CD223 (LAG3), CD270 (HVEM), CD273 (PD-L2), CD274 (PD-L1), CD278 (ICOS), DAP10, LAT, NKD2C SLP76, TRIM, and ZAP70. In some embodiments, the signaling domain can be a paralog or ortholog of any of the foregoing.

Multi-Component CAR/CAL Cells

Presented herein are cells that express the compositions or multi-component CARs and/or CALs presented herein. A cell can be any cell, for example, any mammalian cell, e.g., a human cell. In one embodiment, the cell is a dendritic cell, regulatory T cell, or effector T cell. In one embodiment the cell is a dendritic cell (CAL DC), a T cell (e.g., effector, regulatory, etc.) (CAL-T); regulatory T cell, effector T cell, natural killer cell (CAL NK), or any other myeloid cell.

In one aspect, described herein is an engineered cell expressing and/or comprising one or more multi-component CARs/CALs, or a composition comprising the same as described herein, e.g., at least one signaling polypeptide and at least one recognition polypeptide. In some embodiments, the cell is a natural killer (NK) cell, dendritic cell, regulatory T cell, effector T cell. Such cells expressing and/or comprising both a signaling polypeptide and at least one recognition polypeptide of a multi-component CAR/CAL are referred to herein as "complete multi-component CAR/CAL" cells. In some embodiments, a complete multi-component CAR/CAL cell expresses both a signaling polypeptide (e.g., a CAR) and at least one recognition polypeptide (e.g. a CAL or adaptor as described elsewhere herein) of a multi-component CAL and/or CAR. In some embodiments, a complete multi-component CAL and/or CAR cell comprises nucleic acid sequences encoding both a signaling polypeptide and at least one recognition polypeptide of a multi-component CAL and/or CAR. In some embodiments, a signaling polypeptide is present on the membrane of a cell. In some embodiments, the one or more recognition polypeptides are present in the extracellular space, e.g., the recognition polypeptide(s) can be expressed and secreted by the cell or the cell can be contacted by recognition polypeptides provided from another source (e.g. produced synthetically or by another cell and optionally, purified or processed before the contacting step).

In any of the aspects described herein, e.g., those relating to either a complete or partial multi-component CAL and/or CAR cell, the recognition and/or signaling polypeptide can be under the control of an inducible and/or repressible promoter. Such promoters allow the expression of the polypeptide to be increased or decreased as desired and are in contrast to constitutive promoters. The term "constitutively active promoter" refers to a promoter of a gene which is expressed at all times within a given cell. Exemplary promoters for use in mammalian cells include cytomegalovirus (CMV), Elongation Factor 1a (EF1a), and the like. The term "inducible promoter" refers to a promoter of a gene which can be expressed in response to a given signal, for example addition or reduction of an agent. Non-limiting examples of an inducible promoter are promoters that are regulated in a specific tissue type, a promoter regulated by a steroid hormone, by a polypeptide hormone (e.g., by means of a signal transduction pathway), or by a heterologous polypeptide (e.g., the tetracycline-inducible systems, "Tet-On" and "Tet-Off"; see, e.g., Clontech Inc., CA, Gossen and Bujard, Proc. Natl. Acad. Sci. USA 89:5547, 1992, and Paillard, Human Gene Therapy 9:983, 1989; each of which are incorporated by reference herein in its entirety). In some embodiments, expression of the polypeptide can be precisely regulated, for example, by using an inducible regulatory sequence that is sensitive to certain physiological regulators, e.g., circulating glucose levels, or hormones (Docherty et al., 1994, FASEB J. 8:20-24). Such inducible expression systems, suitable for the control of expression in cells or in mammals include, for example, regulation by ecdysone, by estrogen, progesterone, tetracycline, chemical inducers of dimerization, and isopropyl-beta-D1-thiogalactopyranoside (IPTG). A person skilled in the art would be able to choose the appropriate regulatory/promoter sequence based on the intended use of the polypeptide.

In some embodiments, the expression of one or more of the recognition or signaling polypeptides can be constitutive. In some embodiments, the expression of one or more of the recognition or signaling polypeptides can be transient. Transient expression can be achieved by, e.g., use of transient and/or inducible expression promoters or by use of transient vectors, e.g. those that do not incorporate into the genome and/or persist in the target cell. By way of non-limiting example, derivatives of viruses such as the bovine papillomavirus (BPV-1), or Epstein-Barr virus (pHEBo, pREP-derived and p205) can be used for transient expression of nucleic acids in eukaryotic cells. For other suitable expression systems as well as general recombinant procedures, see Molecular Cloning A Laboratory Manual, 2nd Ed., ed. by Sambrook, Fritsch and Maniatis (Cold Spring Harbor Laboratory Press: 1989) Chapters 16 and 17; which is incorporated by reference herein in its entirety. In some embodiments, the signaling polypeptide of a multi-component CAL and/or CAR can be constitutively expressed and the recognition polypeptide can be transiently expressed. In some embodiments, the recognition polypeptide of a multi-component CAL and/or CAR can be constitutively expressed and the signaling polypeptide can be transiently expressed. In some embodiments, the recognition polypeptide of a multi-component CAL can be constitutively expressed and the signaling polypeptide can be provided exogenously. In some embodiments, the recognition polypeptide of a multi-component CAL can be transiently expressed and the signaling polypeptide can be provided exogenously. In some embodiments, the signaling polypeptide of a multi-component CAL and/or CAR can be constitutively expressed and the recognition polypeptide can be provided exogenously. In some embodiments, the signaling polypeptide of a multi-component CAL and/or CAR can be transiently expressed and the recognition polypeptide can be provided exogenously.

The CARs and CALs described herein can be produced according to any method known in the art, e.g., recombinant expression or peptide synthesis. Exemplary methods can include, the NIH Tetramer Core Facility's MHC expression protocols (available on the world wide web at tetramer.yerkes.emory.edu/support/protocols#1); ProImmune's pentamer protocols (available on the world wide web at proimmune.com/protocols-2/); Immudex's dextramer protocols (available on the word wide web at immudex.com/resources/protocols/) and the CAR T cell production protocols provided in the "Primary Human T cells Isolation and Culture" and "Lentiviral Transduction of Human T cells" sub-sections in "Method Details" section of Cho et al., 2018 Cell 173:1426-1438; each of which is incorporated by reference herein in its entirety.

In one aspect, described herein is a method of killing a target cell, the method comprising contacting the cell with a complete multi-component CAR cell, CAR, and/or CAL according to any of the embodiments described herein. In some embodiments, the target cell can be a diseased cell, e.g., an autoreactive or alloreactive T cell. In one aspect, described herein is a method of treating or preventing a disease, e.g., an autoimmune diseases or conditions; T cell mediated inflammation or immune response; transplant rejection, or GvHD, comprising administering a complete multi-component CAR cell, CAR, and/or CAL according to any of the embodiments described herein. In one aspect, described herein is a method of treating or preventing autoimmune diseases or conditions; T cell mediated inflammation or immune response; transplant rejection; or GvHD, comprising administering a complete multi-component CAR cell, CAR, and/or CAL according to any of the embodiments described herein.

Another aspect provided herein is a method of preventing and/or treating a malignant T cell condition in a subject in need thereof, the method comprising administering to the subject any of the compositions and/or cells described herein. In one aspect, described herein is a method of treating or preventing a malignant T cell condition in a subject, comprising administering a complete multi-component CAR/CAL, CAR and/or CAL as according to any of the embodiments described herein. In one aspect, described herein is a method of treating or preventing a malignant T cell condition in a subject, comprising administering a complete multi-component CAR cell, CAR, and/or CAL according to any of the embodiments described herein In some embodiments, the complete multi-component CAL and/or CAR cell can be autologous or allogeneic to the subject. In some embodiments, the complete multi-component CAL and/or CAR cell can be derived and/or descended from a cell obtained from the subject or a third party and has been modified ex vivo to comprise the at least one multi-component CAL and/or CAR, e.g., genetically engineered to comprise nucleic acid sequences encoding both a signaling polypeptide and at least one recognition polypeptide of a multi-component CAL and/or CAR. In some embodiments, the method can further comprise the steps of obtaining a cell from a subject (e.g. a dendritic cell, regulatory T cell, or effector T cell), altering the cell to comprise nucleic acid sequences encoding both a signaling polypeptide and at least one recognition polypeptide of a multi-component CAL and/or CAR, and then administering the cell to the subject.

In one embodiment, the engineered cell is further modified to lack or have reduced expression of the native MHCI/II, e.g., as measured on the cell surface. Methods for engineering a cell to reduce or eliminate the native MHCI/II are known in the art and include, e.g., expression of RNA interference (such as short hairpin RNA, small interfering RNA, double stranded RNA, etc.), expression of an inhibitory oligonucleotide, nuclease-based inhibition (such as CRISPR, TALEN, Meganuclease, etc.), and expression of a KDEL-motif (SEQ ID NO: 2749) containing binding protein capable of restricting MHCI/II to the endoplasmic reticulum. One skilled in the art can assess whether knockdown of native MHCI/II is achieved by assessing mRNA or protein levels of MHCI/II via, e.g., PCR-based assays or western blotting, respectively.

In one embodiment, the cell is further engineered to knockout the native MHCI/II. Methods for engineering a cell to knockout the native MHCI/II are known in the art and include, e.g., expression of RNA interference (such as short hairpin RNA, small interfering RNA, double stranded RNA, etc.), expression of an inhibitory oligonucleotide, nuclease-based inhibition (such as CRISPR, TALEN, Meganuclease, etc.). One skilled in the art can assess whether knockout of native MHCI/II is achieved by assessing mRNA or protein levels of MHCI/II via, e.g., PCR-based assays or western blotting, respectively.

In one aspect, described herein is an engineered cell expressing and/or comprising one or more of the compositions according to any of the embodiments described herein. In one aspect, described herein is an engineered cell expressing and/or comprising one or more multi-component CAL and/or CAR signaling polypeptides according to any of the embodiments described herein. In some embodiments, the cell is a dendritic cell, regulatory T cell, or effector T cell. In some embodiments, the cell is a T cell. Such cells expressing and/or comprising a multi-component CAL and/or CAR signaling polypeptide are referred to herein as "partial multi-component CAL" cells or "partial multi-component CAR" cells. In some embodiments, the partial multi-component CAL and/or CAR cell does not express, e.g., does not comprise a nucleic acid sequence encoding, a multi-component CAL and/or CAR recognition polypeptide. In some embodiments, a partial multi-component CAL and/or CAR cell comprises a nucleic acid sequence encoding at least one multi-component CAL and/or CAR signaling polypeptide. In some embodiments, the multi-component CAL and/or CAR signaling polypeptide is present on the membrane of the cell, e.g., is expressed as a transmembrane protein at detectable levels. In some embodiments, the signaling polypeptide further comprises a secondary protein interaction domain that specifically binds with the protein interaction domain of the second recognition polypeptide, e.g., the signaling polypeptide is part of an AND gate multi-component CAL and/or CAR as described elsewhere herein. In some embodiments, the cell can further comprise a second multi-component CAL and/or CAR signaling polypeptide, e.g., a signaling polypeptide that is part of a second multi-component CAL and/or CAR according to any of the embodiments described herein.

In one aspect, described herein is a method of killing a target cell, the method comprising contacting the target cell with a partial multi-component CAL and/or CAR cell according to any of the embodiments described herein and contacting the target cell with at least one recognition polypeptide of the multi-component CAL and/or CAR. In some embodiments, the target cell can be a diseased cell, e.g., an autoreactive or alloreactive T cell. In some embodiments, the target cell can be a diseased cell, e.g., a cancer cell (e.g., a T cell- or T cell precursor cell-derived neoplasm, hereafter referred to as "T cell neoplasms". In some embodiments, the method can further comprise the steps of obtaining a cell from a subject (e.g. a NK cell, a dendritic cell, regulatory T cell, or effector T cell), altering the cell to comprise a nucleic acid sequence encoding a signaling polypeptide of a multi-component CAL and/or CAR, and then administering the cell to the subject.

In some embodiments of any of the methods described herein, a pair of protein interaction domains of a multi-component CAL and/or CAR can comprise chemically induced binding domains and the method can further comprise administering a compound that induces binding of the domains. In some embodiments, when one protein interaction domain is FKBP-binding domain of mTOR (FRB) and a second protein interaction domain is FK506 binding protein (FKBP), the method further comprises administering tacrolimus, a rapalog, or everolimus. In some embodiments, when one protein interaction domain is cyclophilin-Fas fusion protein (CyP-Fas) and a second protein interaction domain is FK506 binding protein (FKBP), the method further comprises administering FKCsA. In some embodiments, when one protein interaction domain is calcineurin A (CNA) and a second protein interaction domain is FK506 binding protein (FKBP), the method further comprises administering FK506. In some embodiments, when one protein interaction domain is gibberellin insensitive (GIA) and a second protein interaction domain is gibberellin insensitive dwarf1 (GID1), the method further comprises administering gibberellin. In some embodiments, when one protein interaction domain is Snap-tag and a second protein interaction domain is Halo tag, the method further comprises administering HaXS. In some embodiments, when one protein interaction domain is T14-3-3-cdeltaC and a second protein interaction domain is C-Terminal peptides of PMA2 (CT52), the method further comprises administering fusicoccin.

In some embodiments of any of the aspects described herein, a recognition and/or signaling polypeptide of a multi-component CAL and/or CAR can be engineered. In some embodiments of any of the aspects described herein, a recognition and/or signaling polypeptide of a multi-component CAL and/or CAR can be transgenic. In some embodiments of any of the aspects described herein, a recognition and/or signaling polypeptide of a multi-component CAL and/or CAR can be recombinant. In some embodiments of any of the aspects described herein, a recognition and/or signaling polypeptide of a multi-component CAL and/or CAR can be heterologous to a cell. In some embodiments of any of the aspects described herein, a recognition and/or signaling polypeptide of a multi-component CAL and/or CAR can be heterologous to a T cell. In some embodiments of any of the aspects described herein, a recognition and/or signaling polypeptide of a multi-component CAL and/or CAR can be heterologous to a human T cell. In some embodiments of any of the aspects described herein, a recognition and/or signaling polypeptide of a multi-component CAL and/or CAR can be exogenous to a cell. In some embodiments of any of the aspects described herein, a recognition and/or signaling polypeptide of a multi-component CAL and/or CAR can be exogenous to a T cell. In some embodiments of any of the aspects described herein, a recognition and/or signaling polypeptide of a multi-component CAL and/or CAR can be exogenous to a human T cell.

It is specifically contemplated herein that each of the individual embodiments described herein can be combined, e.g., in a single cell. By way of non-limiting example, a single cell could comprise a first complete multi-component CAL and/or CAR and a second partial multi-component CAL and/or CAR, wherein each multi-component CAL and/or CAR can be according to any of the embodiments described herein.

In some embodiments, the methods described herein relate to CAL-immune cell therapies. In some embodiments, the methods described herein relate to CAR-immune cell therapies such as CAR-T therapy. Standard CAR-T and related therapies relate to adoptive cell transfer of immune cells (e.g. T cells) expressing a CAR that binds specifically to a targeted cell type (e.g. disease cells, e.g., autoreactive or alloreactive T cells) to treat a subject, e.g., for an autoimmune diseases or conditions; T cell mediated inflammation or immune response; transplant rejection; or GvHD.

In some embodiments, the cells administered as part of the therapy can be autologous to the subject. In some embodiments, the cells administered as part of the therapy are not autologous to the subject. In some embodiments, the cells are engineered and/or genetically modified to express a multi-component CAL and/or CAR, or portion thereof as described herein. Further discussion of CAR-T therapies can be found, e.g., in Maus et al. Blood 2014 123:2624-35; Reardon et al. Neuro-Oncology 2014 16:1441-1458; Hoyos et al. Haematologica 2012 97:1622; Byrd et al. J Clin Oncol 2014 32:3039-47; Maher et al. Cancer Res 2009 69:4559-4562; and Tamada et al. Clin Cancer Res 2012 18:6436-6445; each of which is incorporated by reference herein in its entirety.

In some embodiments, the technology described herein relates to a syringe or catheter, including an organ-specific catheter (e.g., renal catheter, biliary catheter, cardiac catheter, etc.), comprising a therapeutically effective amount of a composition described herein.

Methods of Treatment

In some embodiments, the methods described herein relate to the treatment or prevention of transplant rejection in a subject having a cell, tissue, or organ transplant with one or more compositions, CALs, CARS, or cells as described herein. In another embodiment, the methods described herein relate to the treatment or prevention of GvHD in a subject having a cell, tissue, or organ transplant with one or more compositions, CALs, CARS, or cells as described herein.

As used herein, "GvHD" refers to a disease characterized by the active process of donor cells attacking the recipient's own cells. GvHD can develop soon after a transplant, e.g., within weeks or months (acute GvHD), or can occur much later after the transplant, e.g., at least 3-6 months later (chronic GvHD). Symptoms of acute GvHD include, but are not limited to, skin rash or blisters, abdominal pain or discomfort, diarrhea, jaundice, and edema. Symptoms of chronic GvHD include, but are not limited to, changes to skin or nail texture, hair loss or thinning, muscle pain or weakness, blurred vision, mouth sores, shortness of breath, persistent cough, abdominal pain or discomfort, and diarrhea.

A subject can be identified as having or be at risk of having GvHD by a skilled clinician. Diagnostic tests useful in identifying a subject having GvHD are known in the art and will vary based on the type of transplant the subject has received. The diagnosis of GvHD is made by, for example, physical examination for the signs and symptoms for GvHD known in the art, serologic testing for dysfunction of the liver, gall bladder, kidney, and hematopoietic cells, histologic analysis of biopsies obtained from affected organs, and radiologic imaging of affected organs. In one embodiment, the method further comprises administering at least a second therapeutic. In one embodiment, the composition, CARs, CALs, or cells described herein are administered in combination with Abatacept (Orencia®) or Belatacept (Nulojix®). Abatacept and Belatacept, developed by Bristol-Meyers Squibb, are fusion proteins composed of the Fc region of the immunoglobulin IgG1 fused to the extracellular domain of CTLA-4. Abatacept is currently approved by the FDA for treatment of rheumatoid arthritis. Belatacept, which only differs from Abatacept by two amino acids, is an immunosuppressant intended to prevent rejection following a kidney transplant.

In one embodiment, the transplant is vascularized composite allograft (VCA). In one embodiment, the transplant is any human or non-human cell, tissue, or organ. In another embodiment, the transplant is any type of transplants procedures, e.g., any heart transplant, any lung transplant, any liver transplant, any pancreas transplant, any cornea transplant, any trachea transplant, any kidney transplant, any skin transplant, any pancreatic islet cell transplant, any allograft (e.g., a transplantation of allogeneic tissue), any xenograft (e.g., a transplantation of xenogeneic tissue), or any autograft (e.g., a transplantation of tissue). A skilled practitioner will be able to perform a transplant or identify a subject having had a transplant using standard procedural protocols.

In some embodiments, the methods described herein relate to the treatment or prevention of an autoimmune diseases or conditions, or hypersensitivity reaction I-IV, or immune reaction against foreign therapeutic proteins/molecules, or T cell mediated inflammation or immune response; with compositions, CARS, CALs, or cells as described herein. Subjects having an autoimmune disease can be identified by a physician using current methods of diagnosing an autoimmune disease. Symptoms and/or complications of an autoimmune disease which characterize these conditions and aid in diagnosis are well known in the art and include but are not limited to, fatigue, achy muscles, swelling and redness, low-grade fever, numbness or tingling of the hands or feet, hair loss, and/or skin rash. Tests that may aid in a diagnosis of, e.g. autoimmune disease include, but are not limited to, blood counts, and an antinuclear antibody test (ANA). A family history of autoimmune disease, or having risk factors for autoimmune disease (e.g. gender, age, ethnicity, and exposure to environmental agents, such as procainamide, hydralazine, mercury, gold, or silver) can also aid in determining if a subject is likely to have autoimmune disease or in making a diagnosis of autoimmune disease.

As used herein, the term "autoimmune disease", "autoimmune condition", or "autoimmune disease or disorder" herein is a disease or disorder arising from and directed against an individual's own tissues or a co-segregate or manifestation thereof or resulting condition therefrom.

Auto-immune related diseases and disorders arise from an overactive and/or abnormal immune response of the body against substances (autoantigens) and tissues normally present in the body, otherwise known as self or autologous substance. This dysregulated inflammatory reaction causes an exaggerated response by macrophages, granulocytes, lymphocytes, and/or T-lymphocytes leading to abnormal tissue damage and cell death. Subsequent loss of function is associated with inflammatory tissue damage.

Autoantigens, as used herein, are endogenous proteins or fragments thereof that are involved in or elicit this pathogenic immune response. Autoantigen can be any substance, or a portion thereof normally found within a mammal that, in an autoimmune disease, becomes the primary (or a primary, or secondary) target of attack by the immune system. The term also includes antigenic substances that induce conditions having the characteristics of an autoimmune disease when administered to mammals. Additionally, the term includes peptidic subclasses consisting essentially of immunodominant epitopes or immunodominant epitope regions of autoantigens. Immunodominant epitopes or regions in induced autoimmune conditions are fragments of an autoantigen that can be used instead of the entire autoantigen to induce the disease. In humans afflicted with an autoimmune disease, immunodominant epitopes or regions are fragments of antigens specific to the tissue or organ under autoimmune attack and recognized by a substantial percentage (e.g. a majority though not necessarily an absolute majority) of autoimmune attack T-cells.

Autoantigens that are known to be associated with autoimmune disease include myelin proteins with demyelinating diseases, e.g. multiple sclerosis and experimental autoimmune myelitis; collagens and rheumatoid arthritis; insulin, proinsulin, glutamic acid decarboxylase 65 (GAD65); and islet cell antigen (ICA512; ICA12) for insulin dependent diabetes.

A common feature in a number of autoimmune related diseases and inflammatory conditions is the involvement of pro-inflammatory CD4+ T cells. These T cells are responsible for the release of inflammatory, Th1 type cytokines. Cytokines characterized as Th1 type include interleukin 2 (IL-2), γ-interferon, TNFα and IL-12. In some embodiments, cytokines characterized as Th1 type include interleukin 2 (IL-2), interferon γ, and TNFα. Such pro-inflammatory cytokines act to stimulate the immune response, in many cases resulting in the destruction of autologous tissue. Cytokines associated with suppression of T cell response are the Th2 type, and include IL-10, IL-4 and TGF-β. It has been found that Th1 and Th2 type T cells may use the identical antigen receptor in response to an immunogen; in the former producing a stimulatory response and, in the latter, a suppressive response.

T cell mediated inflammation, or a T cell mediated immune response is inflammation and/or an immune response in which T cells and/or T cell activity contributes to or originates the inflammation/immune response.

As used herein, "inflammation" refers to the complex biological response to harmful stimuli, such as pathogens, damaged cells, or irritants. Inflammation is a protective attempt by the organism to remove the injurious stimuli as well as initiate the healing process for the tissue. Accordingly, the term "inflammation" includes any cellular process that leads to the production of pro-inflammatory cytokines, inflammation mediators and/or the related downstream cellular events resulting from the actions of the cytokines thus produced, for example, fever, fluid accumulation, swelling, abscess formation, and cell death. Inflammation can include both acute responses (i.e., responses in which the inflammatory processes are active) and chronic responses (i.e., responses marked by slow progression and formation of new connective tissue). Acute and chronic inflammation may be distinguished by the cell types involved. Acute inflammation often involves polymorphonuclear neutrophils; whereas chronic inflammation is normally characterized by a lymphohistiocytic and/or granulomatous response. An inflammatory condition is any disease state characterized by inflammatory tissues (for example, infiltrates of leukocytes such as lymphocytes, neutrophils, macrophages, eosinophils, mast cells, basophils and dendritic cells) or inflammatory processes which provoke or contribute to the abnormal clinical and histological characteristics of the disease state.

As used herein, an "immune response" refers to a response by a cell of the immune system, such as a B cell, T cell (CD4 or CD8), regulatory T cell, antigen-presenting cell, dendritic cell, monocyte, macrophage, NKT cell, NK cell, basophil, eosinophil, or neutrophil, to a stimulus (e.g., to an a disease, an antigen, or healthy cells, e.g., in the case of autoimmunity). In some embodiments of the aspects described herein, an immune response is a T cell response, such as a CD4+ response or a CD8+ response. Such responses by these cells can include, for example, cytotoxicity, proliferation, cytokine or chemokine production, trafficking, or phagocytosis, and can be dependent on the nature of the immune cell undergoing the response. Stimulation of an immune response refers to an induction or increase of the immune response. Suppression of an immune response refers to an elimination or decrease of the immune response.

A "cell-mediated immune response" is one mediated by T-cells and/or other white blood cells. A "cell-mediated immune response" is elicited by the presentation of antigenic epitopes in association with Class I or Class II molecules of the major histocompatibility complex (MHC), CD1 or other non-classical MHC-like molecules. This activates antigen-specific CD4+T helper cells or CD8+ cytotoxic lymphocyte cells ("CTLs"). CTLs have specificity for peptide antigens that are presented in association with proteins encoded by classical or non-classical MI-ICs and expressed on the surfaces of cells. CTLs help induce and promote the intracellular destruction of intracellular microbes, or the lysis of cells infected with such microbes. Another aspect of cellular immunity involves an antigen-specific response by helper T-cells. Helper T-cells act to help stimulate the function, and focus the activity of, nonspecific effector cells against cells displaying peptide or other antigens in association with classical or non-classical MHC molecules on their surface. A "cell-mediated immune response" also refers to the production of cytokines, chemokines and other such molecules produced by activated T-cells and/or other white blood cells, including those derived from CD4+ and CD8+ T-cells. The stimulation of a cell-mediated immunological response may be determined by a number of assays, such as by lymphoproliferation (lymphocyte activation) assays, CTL cytotoxic cell assays, by assaying for T-lymphocytes specific for the antigen in a sensitized subject, or by measurement of cytokine production by T cells in response to re-stimulation with antigen. Such assays are well known in the art. See, e.g., Erickson et al. (1993) J. Immunol. 151:4189-4199; and Doe et al. (1994) Eur. J. Immunol. 24:2369-2376.

In some embodiments, the T cell mediated immune response is a response to a drug administered to the subject. It is contemplated herein that the present technology can be utilized for depletion of anti-drug specific T cells to prevent immune responses against administered biologics, cell therapies, and/or gene therapies. For example, the methods and compositions described herein can be used to prevent or treat anti-AAV and anti-transgene immune responses for administered adeno-associated virus (AAV) gene therapies, preventing or treating immune to responses to genome editing agents such as CRISPR/Cas9, Transcription activator-like effector nucleases (TALENs), or Zinc Finger Nucleases (ZFNs), and preventing or treating immune responses to enzyme replacement therapies such as recombinant human acid α-glucosidase (Pompe disease), α-L-iduronidase (Mucopolysaccharidosis I), and α-galactosidase (Fabry disease).

In one embodiment of any one of the methods described, the autoimmune disorder is selected from the group consisting of thyroiditis, type 1 diabetes mellitus, Hashimoto's thyroiditis, Graves' disease, celiac disease, multiple sclerosis, Guillain-Barre syndrome, Addison's disease, and Raynaud's phenomenon, Goodpasture's disease, arthritis (rheumatoid arthritis such as acute arthritis, chronic rheumatoid arthritis, gout or gouty arthritis, acute gouty arthritis, acute immunological arthritis, chronic inflammatory arthritis, degenerative arthritis, type II collagen-induced arthritis, infectious arthritis, Lyme arthritis (e.g., post treatment Lyme disease syndrome), proliferative arthritis, psoriatic arthritis, Still's disease, vertebral arthritis, and juvenile-onset rheumatoid arthritis, arthritis chronica progrediente, arthritis deformans, polyarthritis chronica primaria, reactive arthritis, and ankylosing spondylitis), palindromic arthritis, inflammatory hyperproliferative skin diseases, psoriasis such as plaque psoriasis, guttate psoriasis, pustular psoriasis, and psoriasis of the nails, atopy including atopic diseases such as hay fever and Job's syndrome, dermatitis including contact dermatitis, chronic contact dermatitis, exfoliative dermatitis, allergic dermatitis, allergic contact dermatitis, dermatitis herpetiformis, nummular dermatitis, seborrheic dermatitis, non-specific dermatitis, primary irritant contact dermatitis, and atopic dermatitis, x-linked hyper IgM syndrome, allergic intraocular inflammatory diseases, urticaria such as chronic allergic urticaria and chronic idiopathic urticaria, including chronic autoimmune urticaria, myositis, polymyositis/dermatomyositis, juvenile dermatomyositis, toxic epidermal necrolysis, scleroderma (including systemic scleroderma), sclerosis such as systemic sclerosis, multiple sclerosis (MS) such as spino-optical MS, primary progressive MS (PPMS), and relapsing remitting MS (RRMS), progressive systemic sclerosis, atherosclerosis, arteriosclerosis, sclerosis disseminata, ataxic sclerosis, neuromyelitis optica (NMO), inflammatory bowel disease (IBD) (for example, Crohn's disease, autoimmune-mediated gastrointestinal diseases, colitis such as ulcerative colitis, colitis ulcerosa, microscopic colitis, collagenous colitis, colitis polyposa, necrotizing enterocolitis, and transmural colitis, and autoimmune inflammatory bowel disease), bowel inflammation, pyoderma gangrenosum, erythema nodosum, primary sclerosing cholangitis, respiratory distress syndrome, including adult or acute respiratory distress syndrome (ARDS), meningitis, inflammation of all or part of the uvea, iritis, choroiditis, an autoimmune hematological disorder, rheumatoid spondylitis, rheumatoid synovitis, hereditary angioedema, cranial nerve damage as in meningitis, herpes gestationis, pemphigoid gestationis, pruritis scroti, autoimmune premature ovarian failure, sudden hearing loss due to an autoimmune condition, IgE-mediated diseases such as anaphylaxis and allergic and atopic rhinitis, encephalitis such as Rasmussen's encephalitis and limbic and/or brainstem encephalitis, uveitis, such as anterior uveitis, acute anterior uveitis, granulomatous uveitis, non-granulomatous uveitis, phacoantigenic uveitis, posterior uveitis, or autoimmune uveitis, glomerulonephritis (GN) with and without nephrotic syndrome such as chronic or acute glomerulonephritis such as primary GN, immune-mediated GN, membranous GN (membranous nephropathy), idiopathic membranous GN or idiopathic membranous nephropathy, membrano- or membranous proliferative GN (MPGN), including Type I and Type II, and rapidly progressive GN, proliferative nephritis, autoimmune polyglandular endocrine failure, balanitis including balanitis circumscripta plasmacellularis, balanoposthitis, erythema annulare centrifugum, erythema dyschromicum perstans, eythema multiform, granuloma annulare, lichen nitidus, lichen sclerosus et atrophicus, lichen simplex chronicus, lichen spinulosus, lichen planus, lamellar ichthyosis, epidermolytic hyperkeratosis, premalignant keratosis, pyoderma gangrenosum, allergic conditions and responses, allergic reaction, eczema including allergic or atopic eczema, asteatotic eczema, dyshidrotic eczema, and vesicular palmoplantar eczema, asthma such as asthma bronchiale, bronchial asthma, and auto-immune asthma, conditions involving infiltration of T cells and chronic inflammatory responses, immune reactions against foreign antigens such as fetal A-B-O blood groups during pregnancy, chronic pulmonary inflammatory disease, autoimmune myocarditis, leukocyte adhesion deficiency, lupus, including lupus nephritis, lupus cerebritis, pediatric lupus, non-renal lupus, extra-renal lupus, discoid lupus and discoid lupus erythematosus, alopecia lupus, systemic lupus erythematosus (SLE) such as cutaneous SLE or subacute cutaneous SLE, neonatal lupus syndrome (NLE), and lupus erythematosus disseminatus, juvenile onset (Type I) diabetes mellitus, including pediatric insulin-dependent diabetes mellitus (IDDM), adult onset diabetes mellitus (Type II diabetes), autoimmune diabetes, idiopathic diabetes insipidus, diabetic retinopathy, diabetic nephropathy, diabetic large-artery disorder, immune responses associated with acute and delayed hypersensitivity mediated by cytokines and T-lymphocytes, sarcoidosis, granulomatosis including lymphomatoid granulomatosis, Wegener's granulomatosis, agranulocytosis, vasculitides, including vasculitis, large-vessel vasculitis (including polymyalgia rheumatica and giant-cell (Takayasu's) arteritis), medium-vessel vasculitis (including Kawasaki's disease and polyarteritis nodosa/periarteritis nodosa), microscopic polyarteritis, immunovasculitis, CNS vasculitis, cutaneous vasculitis, hypersensitivity vasculitis, necrotizing vasculitis such as systemic necrotizing vasculitis, and ANCA-associated vasculitis, such as Churg-Strauss vasculitis or syndrome (CSS) and ANCA-associated small-vessel vasculitis, temporal arteritis, autoimmune aplastic anemia, Coombs positive anemia, Diamond Blackfan anemia, hemolytic anemia or immune hemolytic anemia including autoimmune hemolytic anemia (AIHA), pernicious anemia (anemia perniciosa), Addison's disease, pure red cell anemia or aplasia (PRCA), Factor VIII deficiency, hemophilia A, autoimmune neutropenia, pancytopenia, leukopenia, diseases involving leukocyte diapedesis, CNS inflammatory disorders, multiple organ injury syndrome such as those secondary to septicemia, trauma or hemorrhage, antigen-antibody complex-mediated diseases, anti-glomerular basement membrane disease, anti-phospholipid antibody syndrome, allergic neuritis, Behcet's disease/syndrome, Castleman's syndrome, Goodpasture's syndrome, Reynaud's syndrome, Sjogren's syndrome, Stevens-Johnson syndrome, pemphigoid such as pemphigoid bullous and skin pemphigoid, pemphigus (including pemphigus vulgaris, pemphigus foliaceus, pemphigus mucus-membrane pemphigoid, and pemphigus erythematosus), autoimmune polyendocrinopathies, Reiter's disease or syndrome, an immune complex disorder such as immune complex nephritis, antibody-mediated nephritis, polyneuropathies, chronic neuropathy such as IgM polyneuropathies or IgM-mediated neuropathy, and autoimmune or immune-mediated thrombocytopenia such as idiopathic thrombocytopenic purpura (ITP) including chronic or acute ITP, scleritis such as idiopathic cerato-scleritis, episcleritis, autoimmune disease of the testis and ovary including autoimmune orchitis and oophoritis, primary hypothyroidism, hypoparathyroidism, autoimmune endocrine diseases including thyroiditis such as autoimmune thyroiditis, Hashimoto's disease, chronic thyroiditis (Hashimoto's thyroiditis), or subacute thyroiditis, idiopathic hypothyroidism, Grave's disease, polyglandular syndromes such as autoimmune polyglandular syndromes (or polyglandular endocrinopathy syndromes), paraneoplastic syndromes, including neurologic paraneoplastic syndromes such as Lambert-Eaton myasthenic syndrome or Eaton-Lambert syndrome, stiff-man or stiff-person syndrome, encephalomyelitis such as allergic encephalomyelitis or encephalomyelitis allergica and experimental allergic encephalomyelitis (EAE), myasthenia gravis such as thymoma-associated myasthenia gravis, cerebellar degeneration, neuromyotonia, opsoclonus or opsoclonus myoclonus syndrome (OMS), and sensory neuropathy, multifocal motor neuropathy, Sheehan's syndrome, autoimmune hepatitis, lupoid hepatitis, giant-cell hepatitis, autoimmune chronic active hepatitis, lymphoid interstitial pneumonitis (LIP), bronchiolitis obliterans (non-transplant) vs NSIP, Guillain-Barre syndrome, Berger's disease (IgA nephropathy), idiopathic IgA nephropathy, linear IgA dermatosis, acute febrile neutrophilic dermatosis, subcorneal pustular dermatosis, transient acantholytic dermatosis, cirrhosis such as primary biliary cirrhosis and pneumonocirrhosis, autoimmune enteropathy syndrome, Celiac or Coeliac disease, celiac sprue (gluten enteropathy), refractory sprue, idiopathic sprue, cryoglobulinemia, amylotrophic lateral sclerosis (ALS; Lou Gehrig's disease), coronary artery disease, autoimmune ear disease such as autoimmune inner ear disease (AIED), autoimmune hearing loss, polychondritis such as refractory or relapsed or relapsing polychondritis, pulmonary alveolar proteinosis, Cogan's syndrome/nonsyphilitic interstitial keratitis, Bell's palsy, Sweet's disease/syndrome, rosacea autoimmune, zoster-associated pain, amyloidosis, a non-cancerous lymphocytosis, a primary lymphocytosis, which includes monoclonal B cell lymphocytosis (e.g., benign monoclonal gammopathy and monoclonal gammopathy of undetermined significance, MGUS), peripheral neuropathy, paraneoplastic syndrome, channelopathies including channelopathies of the CNS, autism, inflammatory myopathy, focal or segmental or focal segmental glomerulosclerosis (FSGS), endocrine opthalmopathy, uveoretinitis, chorioretinitis, autoimmune hepatological disorder, fibromyalgia, multiple endocrine failure, Schmidt's syndrome, adrenalitis, gastric atrophy, presenile dementia, demyelinating diseases such as autoimmune demyelinating diseases and chronic inflammatory demyelinating polyneuropathy, Dressler's syndrome, alopecia areata, alopecia totalis, CREST syndrome (calcinosis, Raynaud's phenomenon, esophageal dysmotility, sclerodactyly, and telangiectasia), male and female autoimmune infertility, e.g., due to anti-spermatozoan antibodies, mixed connective tissue disease, Chagas' disease, rheumatic fever, recurrent abortion, farmer's lung, erythema multiforme, post-cardiotomy syndrome, Cushing's syndrome, bird-fancier's lung, allergic granulomatous angiitis, benign lymphocytic angitis, Alport's syndrome, alveolitis such as allergic alveolitis and fibrosing alveolitis, interstitial lung disease, transfusion reaction, Sampter's syndrome, Caplan's syndrome, endocarditis, endomyocardial fibrosis, diffuse interstitial pulmonary fibrosis, interstitial lung fibrosis, pulmonary fibrosis, idiopathic pulmonary fibrosis, cystic fibrosis, endophthalmitis, erythema elevatum et diutinum, erythroblastosis fetalis, eosinophilic faciitis, Shulman's syndrome, Felty's syndrome, cyclitis such as chronic cyclitis, heterochronic cyclitis, iridocyclitis (acute or chronic), or Fuch's cyclitis, Henoch-Schonlein purpura, SCID, sepsis, endotoxemia, post-vaccination syndromes, Evan's syndrome, autoimmune gonadal failure, Sydenham's chorea, post-streptococcal nephritis, thromboangitis ubiterans, thyrotoxicosis, tabes dorsalis, chorioiditis, giant-cell polymyalgia, chronic hypersensitivity pneumonitis, keratoconjunctivitis sicca, idiopathic nephritic syndrome, minimal change nephropathy, benign familial and ischemia-reperfusion injury, transplant organ reperfusion, retinal autoimmunity, aphthae, aphthous stomatitis, arteriosclerotic disorders, aspermiogenesis, autoimmune hemolysis, Boeck's disease, enteritis allergica, erythema nodosum leprosum, idiopathic facial paralysis, chronic fatigue syndrome, febris rheumatica, Hamman-Rich's disease, sensoneural hearing loss, ileitis regionalis, leucopenia, transverse myelitis, primary idiopathic myxedema, ophthalmia symphatica, polyradiculitis acuta, pyoderma gangrenosum, acquired spenic atrophy, vitiligo, toxic-shock syndrome, conditions involving infiltration of T cells, leukocyte-adhesion deficiency, immune responses associated with acute and delayed hypersensitivity mediated by cytokines and T-lymphocytes, diseases involving leukocyte diapedesis, multiple organ injury syndrome, antigen-antibody complex-mediated diseases, antiglomerular basement membrane disease, allergic neuritis, autoimmune polyendocrinopathies, oophoritis, primary myxedema, autoimmune atrophic gastritis, rheumatic diseases, mixed connective tissue disease, nephrotic syndrome, insulitis, polyendocrine failure, autoimmune polyglandular syndrome type I, adult-onset idiopathic hypoparathyroidism (AOIH), myocarditis, nephrotic syndrome, primary sclerosing cholangitis, acute or chronic sinusitis, ethmoid, frontal, maxillary, or sphenoid sinusitis, an eosinophil-related disorder such as eosinophilia, pulmonary infiltration eosinophilia, eosinophilia-myalgia syndrome, Loffler's syndrome, chronic eosinophilic pneumonia, tropical pulmonary eosinophilia, granulomas containing eosinophils, seronegative spondyloarthritides, polyendocrine autoimmune disease, sclerosing cholangitis, sclera, episclera, Bruton's syndrome, transient hypogammaglobulinemia of infancy, Wiskott-Aldrich syndrome, ataxia telangiectasia syndrome, angiectasis, autoimmune disorders associated with collagen disease, rheumatism, allergic hypersensitivity disorders, glomerulonephritides, reperfusion injury, ischemic re-perfusion disorder, lymphomatous tracheobronchitis, inflammatory dermatoses, dermatoses with acute inflammatory components, and autoimmune uveoretinitis (AUR). In some embodiments, the autoimmune disease or condition or T cell mediated inflammation can be neurodegeneration, e.g, Alzheimer's or Parksinson disease.

In some embodiments of any of the aspects, the autoimmune disease or condition, or T cell mediated inflammation can be type 1 diabetes, rheumatoid arthritis, multiple sclerosis, pemphigus, alopecia, lupus, vitiligo, or chronic fatigue syndrome.

As used herein, "malignant T cell condition" refers to a condition in which T cells display one or more of uncontrolled growth (i.e., division beyond normal limits), invasion (i.e., intrusion on and destruction of adjacent tissues), and metastasis (i.e., spread to other locations in the body via lymph or blood). Non-limiting examples of malignant T cell conditions include T cell cancers, lymphoma, leukemia, T cell acute lymphoblastic leukemia, and T cell lymphoblastic lymphoma.

The compositions and methods described herein can be administered to a subject to treat or prevent an autoimmune diseases or conditions; T cell mediated inflammation or immune response; or transplant rejection. In some embodiments, the methods described herein comprise administering an effective amount of compositions, CALs, CARS, or cells described herein to a subject in order to alleviate a symptom of an autoimmune diseases or conditions; T cell mediated inflammation or immune response; or transplant rejection. As used herein, "alleviating a symptom" is ameliorating any condition or symptom associated with the disease or condition. As compared with an equivalent untreated control, such reduction is by at least 5%, 10%, 20%, 40%, 50%, 60%, 80%, 90%, 95%, 99% or more as measured by any standard technique. A variety of means for administering the compositions described herein to subjects are known to those of skill in the art. Such methods can include, but are not limited to oral, parenteral, intravenous, intramuscular, subcutaneous, transdermal, airway (aerosol), pulmonary, cutaneous, topical, injection, or intratumoral administration. Administration can be local or systemic.

The administration of the compositions contemplated herein may be carried out in any convenient manner, including by aerosol inhalation, injection, ingestion, transfusion, implantation or transplantation. In a preferred embodiment, compositions are administered parenterally. The phrases "parenteral administration" and "administered parenterally" as used herein refers to modes of administration other than enteral and topical administration, usually by injection, and includes, without limitation, intravascular, intravenous, intramuscular, intraarterial, intrathecal, intracapsular, intraorbital, intratumoral, intracardiac, intradermal, intraperitoneal, transtracheal, subcutaneous, subcuticular, intraarticular, subcapsular, subarachnoid, intraspinal and intrasternal injection and infusion. In one embodiment, the compositions contemplated herein are administered to a subject by direct injection into a tumor, lymph node, or site of infection.

It can generally be stated that a pharmaceutical composition comprising the cells, e.g., T cells or CAL cells or CAR cells, described herein may be administered at a dosage of $10^2$ to $10^{10}$ cells/kg body weight, preferably $10^5$ to $10^6$ cells/kg body weight, including all integer values within those ranges. The number of cells will depend upon the ultimate use for which the composition is intended as will the type of cells included therein. For uses provided herein, the cells are generally in a volume of a liter or less, can be 500 mLs or less, even 250 mLs or 100 mLs or less. Hence the density of the desired cells is typically greater than $10^6$ cells/ml and generally is greater than $10^7$ cells/ml, generally $10^8$ cells/ml or greater. The clinically relevant number of immune cells can be apportioned into multiple infusions that cumulatively equal or exceed $10^5$, $10^6$, $10^7$, $10^8$, $10^9$, $10^{10}$, $10^{11}$, or $10^{12}$ cells. In some aspects of the present invention, particularly since all the infused cells will be redirected to a particular or specific target antigen, lower numbers of cells, in the range of $10^6$/kilogram ($10^6$-$10^{11}$ per patient) may be administered. CAL and/or CAR expressing cell compositions may be administered multiple times at dosages within these ranges. The cells may be allogeneic, syngeneic, xenogeneic, or autologous to the patient undergoing therapy. If desired, the treatment may also include administration of mitogens (e.g., PHA) or lymphokines, cytokines, and/or chemokines (e.g., IFN-γ, IL-2, IL-12, TNF-alpha, IL-18, and TNF-beta, GM-CSF, IL-4, IL-13, Flt3-L, RANTES, MIP1α, etc.) as described herein to enhance induction of the immune response.

In some embodiments, the dosage can be from about $1\times10^5$ cells to about $1\times10^8$ cells per kg of body weight. In some embodiments, the dosage can be from about $1\times10^6$ cells to about $1\times10^7$ cells per kg of body weight. In some embodiments, the dosage can be about $1\times10^6$ cells per kg of body weight. In some embodiments, one dose of cells can be administered. In some embodiments, the dose of cells can be repeated, e.g., once, twice, or more. In some embodiments, the dose of cells can be administered on, e.g., a daily, weekly, or monthly basis.

The dosage ranges for the agent, e.g., a CAL, CAR, cell, or composition described herein depend upon the potency, and encompass amounts large enough to produce the desired effect e.g., prevention of transplant rejection, reduction in inflammation, etc. The dosage should not be so large as to cause unacceptable adverse side effects. Generally, the dosage will vary with the age, condition, and sex of the patient and can be determined by one of skill in the art. The dosage can also be adjusted by the individual physician in the event of any complication. In some embodiments, the dosage ranges from 0.001 mg/kg body weight to 0.5 mg/kg body weight. In some embodiments, the dose range is from 5 μg/kg body weight to 100 μg/kg body weight. Alternatively, the dose range can be titrated to maintain serum levels between 1 μg/mL and 1000 μg/mL. For systemic administration, subjects can be administered a therapeutic amount, such as, e.g., 0.1 mg/kg, 0.5 mg/kg, 1.0 mg/kg, 2.0 mg/kg, 2.5 mg/kg, 5 mg/kg, 10 mg/kg, 15 mg/kg, 20 mg/kg, 25 mg/kg, 30 mg/kg, 40 mg/kg, 50 mg/kg, or more.

Administration of the doses recited above can be repeated. In some embodiments, the doses are given once a day, or multiple times a day, for example but not limited to three times a day. In some embodiments, the doses recited above are administered daily for several weeks or months. The duration of treatment depends upon the subject's clinical progress and responsiveness to therapy.

In some embodiments, the dose can be from about 2 mg/kg to about 15 mg/kg. In some embodiments, the dose can be about 2 mg/kg. In some embodiments, the dose can be about 4 mg/kg. In some embodiments, the dose can be about 5 mg/kg. In some embodiments, the dose can be about 6 mg/kg. In some embodiments, the dose can be about 8 mg/kg. In some embodiments, the dose can be about 10 mg/kg. In some embodiments, the dose can be about 15 mg/kg. In some embodiments, the dose can be from about 100 mg/m$^2$ to about 700 mg/m$^2$. In some embodiments, the dose can be about 250 mg/m$^2$. In some embodiments, the dose can be about 375 mg/m$^2$. In some embodiments, the dose can be about 400 mg/m$^2$. In some embodiments, the dose can be about 500 mg/m$^2$.

In some embodiments, the dose can be administered intravenously. In some embodiments, the intravenous administration can be an infusion occurring over a period of from about 10 minutes to about 3 hours. In some embodiments, the intravenous administration can be an infusion occurring over a period of from about 30 minutes to about 90 minutes.

In some embodiments the dose can be administered about weekly. In some embodiments, the dose can be administered weekly. In some embodiments, the dose can be administered weekly for from about 12 weeks to about 18 weeks. In some embodiments the dose can be administered about every 2 weeks. In some embodiments the dose can be administered about every 3 weeks. In some embodiments, the dose can be from about 2 mg/kg to about 15 mg/kg administered about every 2 weeks. In some embodiments, the dose can be from about 2 mg/kg to about 15 mg/kg administered about every 3 weeks. In some embodiments, the dose can be from about 2 mg/kg to about 15 mg/kg administered intravenously about every 2 weeks. In some embodiments, the dose can be from about 2 mg/kg to about 15 mg/kg administered intravenously about every 3 weeks. In some embodiments, the dose can be from about 200 mg/m2 to about 400 mg/m2 administered intravenously about every week. In some embodiments, the dose can be from about 200 mg/m2 to about 400 mg/m2 administered intravenously about every 2 weeks. In some embodiments, the dose can be from about 200 mg/m2 to about 400 mg/m2 administered intravenously about every 3 weeks. In some embodiments, a total of from about 2 to about 10 doses are administered. In some embodiments, a total of 4 doses are administered. In some embodiments, a total of 5 doses are administered. In some embodiments, a total of 6 doses are administered. In some embodiments, a total of 7 doses are administered. In some embodiments, a total of 8 doses are administered. In some embodiments, the administration occurs for a total of from about 4 weeks to about 12 weeks. In some embodiments, the administration occurs for a total of about 6 weeks. In some embodiments, the administration occurs for a total of about 8 weeks. In some embodiments, the administration occurs for a total of about 12 weeks. In some embodiments, the initial dose can be from about 1.5 to about 2.5 fold greater than subsequent doses.

In some embodiments, the dose can be from about 1 mg to about 2000 mg. In some embodiments, the dose can be about 3 mg. In some embodiments, the dose can be about 10 mg. In some embodiments, the dose can be about 30 mg. In some embodiments, the dose can be about 1000 mg. In some embodiments, the dose can be about 2000 mg. In some embodiments, the dose can be about 3 mg given by intravenous infusion daily. In some embodiments, the dose can be about 10 mg given by intravenous infusion daily. In some embodiments, the dose can be about 30 mg given by intravenous infusion three times per week.

A therapeutically effective amount is an amount of an agent that is sufficient to produce a statistically significant, measurable change in, or prevent the occurrence of an autoimmune disease or condition; T cell mediated inflammation or immune response; transplant rejection; or GvHD. Such effective amounts can be gauged in clinical trials as well as animal studies.

An agent can be administered intravenously by injection or by gradual infusion over time. Given an appropriate formulation for a given route, for example, agents useful in the methods and compositions described herein can be administered intravenously, intranasally, by inhalation, intraperitoneally, intramuscularly, subcutaneously, intracavity, and can be delivered by peristaltic means, if desired, or by other means known by those skilled in the art. It is preferred that the compounds used herein are administered orally, intravenously or intramuscularly. Local administration, e.g., directly to the site of an organ or tissue transplant is also specifically contemplated.

Therapeutic compositions containing at least one agent can be conventionally administered in a unit dose, for example. The term "unit dose" when used in reference to a therapeutic composition refers to physically discrete units suitable as unitary dosage for the subject, each unit containing a predetermined quantity of active material calculated to produce the desired therapeutic effect in association with the required physiologically acceptable diluent, i.e., carrier, or vehicle.

The compositions are administered in a manner compatible with the dosage formulation, and in a therapeutically effective amount. The quantity to be administered and timing depends on the subject to be treated, capacity of the subject's system to utilize the active ingredient, and degree of therapeutic effect desired.

In embodiments where the subject is administered a partial multi-component CAL and/or CAR cell and a recognition polypeptide, the partial multi-component CAL and/or CAR cell and a recognition polypeptide can be administered together or separately. In embodiments where the subject is separately administered a partial multi-component CAL and/or CAR cell and a recognition polypeptide each of the compositions can be administered, separately, according to any of the dosages and administration routes/routines described herein.

Precise amounts of active ingredient required to be administered depend on the judgment of the practitioner and are particular to each individual. However, suitable dosage ranges for systemic application are disclosed herein and depend on the route of administration. Suitable regimes for administration are also variable but are typified by an initial administration followed by repeated doses at one or more hour intervals by a subsequent injection or other administration. Alternatively, continuous intravenous infusion sufficient to maintain concentrations in the blood in the ranges specified for in vivo therapies are contemplated.

In some embodiments, the methods further comprise administering a composition, CAL, or CAR, or cell described herein along with one or more additional autoimmune, GvHD, or transplant rejection agents, biologics, drugs, or treatments as part of a combinatorial therapy. Exemplary treatments for transplant rejection or GvHD include but are not limited to, Immunosuppressive drugs, e.g., Cyclosporine (Neoral, Sandimmune, Gengraf, and Restasis), Tacrolimus (Prograf, Protopic, Astagraf XL, and Envarsus XR), Methotrexate (Trexall, Rasuvo, Rheumatrex, and Otrexup (PF)), Sirolimus (Rapamune), Mycophenolic acid (Myfortic and CellCept), Rituximab (Rituxan), etanercept (Enbrel), pentostatin (Nipent), ruxolitinib (Jakafi); Chemotherapies, e.g., Methotrexate (Trexall, Rasuvo, Rheumatrex, and Otrexup (PF)), antithymocyte globulin (Atgam, Thymoglobulin); Steroids, e.g., Prednisone (Deltasone, Rayos, and Prednisone Intensol), Methylprednisolone (Medrol, Solu-Medrol, and Depo-Medrol), budesonide (Entocort EC, Uceris); Antifungal, e.g., Posaconazole (Noxafil); Antiviral drugs, e.g., Acyclovir (Zovirax and Sitavig), Valacyclovir (Valtrex); and Antibiotics, e.g., Sulfamethoxazole/Trimethoprim (Bactrim, Sulfatrim, and Bactrim DS); Protease inhibitors, e.g. alpha1-proteinase inhibitor (Zemaira); extracorporeal photopheresis; monoclonal antibodies (daclizumab (Zinbryta), basiliximab (Simulect)), Brentuximab vedotin (Adcetris), Alemtuzumab (Campath, Lemtrada), Tocilizumab (Actemra); infusion of mesenchymal stromal cells.

Exemplary treatments for autoimmune disease include but are not limited to, Insulin, e.g., Insulin glulisine (Apidra and Apidra SoloStar), Insulin detemir (Levemir and Levemir FlexTouch), Insulin aspart (NovoLog, Novolog Flexpen, and Novolog PenFill), Insulin lispro (Humalog and Humalog KwikPen), Insulin, Insulin glargine (Lantus, Lantus Solostar, and Toujeo SoloStar); Dietary supplement, e.g., glucose tablets; and Hormones, e.g., Glucagon (GlucaGen and Glucagon Emergency Kit (human)), antidiabetic agents (Metformin (D-Care DM2, Fortamet, Glucophage, Glucophage XR, Glumetza, Riomet), glucagon-like peptide-1 (GLP-1) receptor agonist (liraglutide (Saxenda; Victoza) or semaglutide (Ozempic) or sodium-glucose co-transporter 2 (SGLT2) inhibitor: empagliflozin (Jardiance), canagliflozin (Invokana); sulfonylureas: glipizide (GlipiZIDE XL, Glucotrol, Glucotrol XL); Meglitinide Analogs: repaglinide (Prandin); Thiazolidinedione: pioglitazone (Actos); dipeptidyl peptidase-4 (DPP-4) inhibitors: Sitagliptin (Januvia), Saxagliptin (Onglyza), Linagliptin (Tradjenta), Alogliptin (Nesina)

The efficacy of a given treatment, e.g., for an autoimmune diseases or conditions; T cell mediated inflammation or immune response; transplant rejection; or GvHD, can be determined by the skilled clinician. However, a treatment is considered "effective treatment," as the term is used herein, if any one or all of the signs or symptoms of are altered in a beneficial manner or other clinically accepted symptoms are improved, or even ameliorated, e.g., by at least 10% following treatment with an agent as described herein. Efficacy can also be measured by a failure of an individual to worsen as assessed by hospitalization or need for medical interventions (i.e., progression of the disease is halted). Methods of measuring these indicators are known to those of skill in the art and/or described herein.

An effective amount for the treatment of a disease means that amount which, when administered to a mammal in need thereof, is sufficient to result in effective treatment as that term is defined herein, for that disease. Efficacy of an agent can be determined by assessing physical indicators of, for example autoimmune disease (e.g., result of an ANA), T cell mediated inflammation or immune response, malignant T cell condition, transplant rejection (e.g., high fever, tenderness at transplant site, etc.), or GvHD (e.g., redness, pain, or other symptoms at transplant site). Effective amounts, toxicity, and therapeutic efficacy can be determined by standard pharmaceutical procedures in cell cultures or experimental animals, e.g., for determining the LD50 (the dose lethal to 50% of the population) and the ED50 (the dose therapeutically effective in 50% of the population). The dosage can vary depending upon the dosage form employed and the route of administration utilized. The dose ratio between toxic and therapeutic effects is the therapeutic index and can be expressed as the ratio LD50/ED50. Compositions and methods that exhibit large therapeutic indices are preferred. A therapeutically effective dose can be estimated initially from cell culture assays. Also, a dose can be formulated in animal models to achieve a circulating plasma concentration range that includes the IC50 (i.e., the concentration of the active ingredient(s), which achieves a half-maximal inhibition of symptoms) as determined in cell culture, or in an appropriate animal model. Levels in plasma can be measured, for example, by immunoassay, various DNA detection technologies, or high performance liquid chromatography. The effects of any particular dosage can be monitored by a suitable bioassay, e.g., assay to assess reaction following transplant, level of inflammation, ANA measurement, among others. The dosage can be determined by a physician and adjusted, as necessary, to suit observed effects of the treatment.

Efficacy can also be measured by a failure of an individual to worsen as assessed by hospitalization, or need for medical interventions (i.e., progression of the disease is halted). Methods of measuring these indicators are known to those of skill in the art and/or are described herein. Treatment includes any treatment of a disease in an individual or an animal (some non-limiting examples include a human or an animal) and includes: (1) inhibiting the disease, e.g., preventing a worsening of symptoms (e.g. pain or inflammation); or (2) relieving the severity of the disease, e.g., causing regression of symptoms. An effective amount for the treatment of a disease means that amount which, when administered to a subject in need thereof, is sufficient to result in effective treatment as that term is defined herein, for that disease. Efficacy of an agent can be determined by assessing physical indicators of a condition or desired response, (e.g. a reduction of inflammation, etc.). It is well within the ability of one skilled in the art to monitor efficacy of administration and/or treatment by measuring any one of such parameters, or any combination of parameters. Efficacy can be assessed in animal models of a condition described herein, for example treatment of autoimmune disease, transplant rejection or GVHD. When using an experimental animal model, efficacy of treatment is evidenced when a statistically significant change in a marker is observed, e.g. inflammation.

In some embodiments, the technology described herein relates to a pharmaceutical composition comprising a CAL and/or CAR, or a multi-component CAL and/or CAR (or portion thereof, or cell comprising a CAL and/or CAR, or a multi-component CAL and/or CAR) as described herein, and optionally a pharmaceutically acceptable carrier. In some embodiments, the active ingredients of the pharmaceutical composition comprise a CAL and/or CAR or a multi-component CAL and/or CAR (or portion thereof, or cell comprising a CAL and/or CAR or a multi-component CAL and/or CAR) as described herein. In some embodiments, the active ingredients of the pharmaceutical composition consist essentially of a CAL and/or CAR or a multi-component CAL and/or CAR (or portion thereof, or cell comprising a CAL and/or CAR or a multi-component CAL and/or CAR) as described herein. In some embodiments, the active ingredients of the pharmaceutical composition consist of a CAL and/or CAR or a multi-component CAL and/or CAR (or portion thereof, or cell comprising a multi-component CAL and/or CAR) as described herein.

Pharmaceutically acceptable carriers and diluents include saline, aqueous buffer solutions, solvents and/or dispersion media. The use of such carriers and diluents is well known in the art. Some non-limiting examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) C2-C12 alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein. In some embodiments, the carrier inhibits the degradation of the active agent as described herein.

In some embodiments, the pharmaceutical composition comprising a multi-component CAL and/or CAR (or portion thereof, or cell comprising a multi-component CAL and/or CAR) as described herein can be a parenteral dose form. Since administration of parenteral dosage forms typically bypasses the patient's natural defenses against contaminants, parenteral dosage forms are preferably sterile or capable of being sterilized prior to administration to a patient. Examples of parenteral dosage forms include, but are not limited to, solutions ready for injection, dry products ready to be dissolved or suspended in a pharmaceutically acceptable vehicle for injection, suspensions ready for injection, and emulsions. In addition, controlled-release parenteral dosage forms can be prepared for administration of a patient, including, but not limited to, DUROS®-type dosage forms and dose-dumping.

Suitable vehicles that can be used to provide parenteral dosage forms of a multi-component CAL and/or CAR (or portion thereof, or cell comprising a multi-component CAL and/or CAR) as disclosed within are well known to those skilled in the art. Examples include, without limitation: sterile water; water for injection USP; saline solution; glucose solution; aqueous vehicles such as but not limited to, sodium chloride injection, Ringer's injection, dextrose Injection, dextrose and sodium chloride injection, and lactated Ringer's injection; water-miscible vehicles such as, but not limited to, ethyl alcohol, polyethylene glycol, and propylene glycol; and non-aqueous vehicles such as, but not limited to, corn oil, cottonseed oil, peanut oil, sesame oil, ethyl oleate, isopropyl myristate, and benzyl benzoate. Compounds that alter or modify the solubility of a pharmaceutically acceptable salt of an active ingredient can also be incorporated into the parenteral dosage forms of the disclosure, including conventional and controlled-release parenteral dosage forms.

Pharmaceutical compositions can also be formulated to be suitable for oral administration, for example as discrete dosage forms, such as, but not limited to, tablets (including without limitation scored or coated tablets), pills, caplets, capsules, chewable tablets, powder packets, cachets, troches, wafers, aerosol sprays, or liquids, such as but not limited to, syrups, elixirs, solutions or suspensions in an aqueous liquid, a non-aqueous liquid, an oil-in-water emulsion, or a water-in-oil emulsion. Such compositions contain a predetermined amount of the pharmaceutically acceptable salt of the disclosed compounds, and may be prepared by methods of pharmacy well known to those skilled in the art. See generally, Remington: The Science and Practice of Pharmacy, 21st Ed., Lippincott, Williams, and Wilkins, Philadelphia Pa. (2005).

Conventional dosage forms generally provide rapid or immediate drug release from the formulation. Depending on the pharmacology and pharmacokinetics of the drug, use of conventional dosage forms can lead to wide fluctuations in the concentrations of the drug in a patient's blood and other tissues. These fluctuations can impact a number of parameters, such as dose frequency, onset of action, duration of efficacy, maintenance of therapeutic blood levels, toxicity, side effects, and the like. Advantageously, controlled-release formulations can be used to control a drug's onset of action, duration of action, plasma levels within the therapeutic window, and peak blood levels. In particular, controlled- or extended-release dosage forms or formulations can be used to ensure that the maximum effectiveness of a drug is achieved while minimizing potential adverse effects and safety concerns, which can occur both from under-dosing a drug (i.e., going below the minimum therapeutic levels) as well as exceeding the toxicity level for the drug. In some embodiments, the composition can be administered in a sustained release formulation.

Controlled-release pharmaceutical products have a common goal of improving drug therapy over that achieved by their non-controlled release counterparts. Ideally, the use of an optimally designed controlled-release preparation in medical treatment is characterized by a minimum of drug substance being employed to cure or control the condition in a minimum amount of time. Advantages of controlled-release formulations include: 1) extended activity of the drug; 2) reduced dosage frequency; 3) increased patient compliance; 4) usage of less total drug; 5) reduction in local or systemic side effects; 6) minimization of drug accumulation; 7) reduction in blood level fluctuations; 8) improvement in efficacy of treatment; 9) reduction of potentiation or loss of drug activity; and 10) improvement in speed of control of diseases or conditions. Kim, Cherng-ju, Controlled Release Dosage Form Design, 2 (Technomic Publishing, Lancaster, Pa.: 2000).

Most controlled-release formulations are designed to initially release an amount of drug (active ingredient) that promptly produces the desired therapeutic effect, and gradually and continually release other amounts of drug to maintain this level of therapeutic or prophylactic effect over an extended period of time. In order to maintain this constant level of drug in the body, the drug must be released from the dosage form at a rate that will replace the amount of drug being metabolized and excreted from the body. Controlled-release of an active ingredient can be stimulated by various conditions including, but not limited to, pH, ionic strength, osmotic pressure, temperature, enzymes, water, and other physiological conditions or compounds.

A variety of known controlled- or extended-release dosage forms, formulations, and devices can be adapted for use with the salts and compositions of the disclosure. Examples include, but are not limited to, those described in U.S. Pat. Nos. 3,845,770; 3,916,899; 3,536,809; 3,598,123; 4,008,719; 5,674,533; 5,059,595; 5,591,767; 5,120,548; 5,073,543; 5,639,476; 5,354,556; 5,733,566; and 6,365,185 B1; each of which is incorporated herein by reference. These dosage forms can be used to provide slow or controlled-release of one or more active ingredients using, for example, hydroxypropylmethyl cellulose, other polymer matrices, gels, permeable membranes, osmotic systems (such as OROS® (Alza Corporation, Mountain View, Calif. USA)), or a combination thereof to provide the desired release profile in varying proportions.

Described herein is a therapy called "CAL-cell therapy", which seeks to help immune killer cells recognize autoreactive and alloreactive T cells. This is accomplished by genetically altering an immune cell so that it expresses a chimeric antigen ligand (CAL). The CAL is an altered ligand, in which the natural recognition portion is removed and replaced with a synthetic recognition portion, (including all synthetic or natural peptide MHC complexes) that is designed to more effectively recognize the autoreactive and alloreactive T cells by very specifically detecting the presence of a T cell receptor unique to the autoreactive and alloreactive T cells. These CAL immune cells are then given to a patient. Inside the patient, their synthetic CAL ligand molecules will bind to the autoreactive and alloreactive T cells and in the act of that binding, activate the killer immune cells, resulting in the engineered CAL-immune cells attacking the pathologic autoreactive and alloreactive T-cells to eliminate or reduce allo- or autoreactive immune response. This has particular applications for autoimmune conditions, cell-, tissue-, organ-transplants, and Graft vs. Host Disease (GvHD).

This invention is based, in part, on the finding that an engineered polypeptide presented herein can recognize and bind to the specific T cell receptor on the disease-causing T cells, deleting said T cells, e.g., eliminating or reducing autoimmune diseases or conditions; T cell mediated inflammation or immune response; and cell, tissue, organ transplants and Graft vs. Host Disease (GvHD). In some embodiments, the engineered polypeptide is composed of a peptide-major histocompatibility complex (pMHC) (e.g. as a monomer, oligomer, or multimer) as the recognition site for the TCR of an allogeneic or an autoreactive T cell. In some embodiments, the pMHC is one of the complexes described herein, e.g., see Tables 5 and 6.

In some embodiments, the engineered polypeptide is composed of a pMHC conjugated to a FITC, PE, or other biomolecular interaction domain described herein. The engineered polypeptide can also be considered as an adaptor molecule (referred to herein as Chimeric Antigen Ligand (CAL)) composed of a TCR recognition domain (e.g., peptide-HLA monomers, oligomers, or multimers) fused to a biomolecular interaction domain. The CAL technology described herein can target T cell clones in an antigen specific manner and is not dependent on any specific CAR construct to exhibit killing effect.

In some embodiments, the engineered polypeptide is a CAR composed of a peptide-HLA (e.g., as a monomer, oligomer, or multimer) as the recognition site fused to signaling domains from T cell receptors. Further provided herein is a split version of this CAR system, in which the CAR is composed of two pieces. The first piece is a universal CAR (also referred to herein as a Uni CAL) with T cell signaling domains as the intracellular portion and a biomolecular interaction domain as the extracellular domain, e.g., that is specific to each disease state. The second piece is an adaptor molecule (referred to herein as Chimeric Antigen Ligand (CAL)) composed of a TCR recognition domain (e.g., peptide-HLA monomers, oligomers, or multimers) fused to the cognate biomolecular interaction domain.

In some embodiments, the engineered polypeptide is a CAR composed of a peptide-HLA (e.g., as a monomer, oligomer, or multimer) as the recognition site fused to signaling domains from T cell receptors. Further provided herein is a split version of this CAR system, in which the CAR is composed of two pieces. The first piece is a universal CAR (also referred to herein as a Uni CAL) with T cell signaling domains as the intracellular portion and a biomolecular interaction domain as the extracellular domain, e.g., that is specific to each disease state. The second piece is an adaptor molecule (referred to herein as Chimeric Antigen Ligand (CAL)) composed of a TCR recognition domain (e.g., peptide-HLA monomers, oligomers, or multimers) fused to the cognate biomolecular interaction domain. It is noted that protein interaction domains are a type of biomolecular interaction domains and where one is specified herein, the other may always be substituted. The CAL technology described herein can target T cells clones in an antigen specific manner and is not dependent on any specific CAR construct to exhibit killing effect.

Accordingly, one aspect presented herein provides a composition comprising (a) chimeric antigen ligand or a TCR recognition domain; and one or both of (a) an intracellular signaling domain; and (b) a first-type protein interaction domain.

Another aspect provided herein provides a composition comprising (a) a first polypeptide comprising a chimeric antigen ligand or TCR recognition domain and a first-type protein interaction domain; and (b) a signaling polypeptide comprising a second-type protein interaction domain and an intracellular signaling domain; wherein the first-type and second-type protein interaction domains bind specifically to each other.

Another aspect provided herein provides a composition comprising (a) a first polypeptide comprising a TCR recognition domain and a first-type protein interaction domain; and (b) a recognition polypeptide comprising a second recognition domain and a third-type protein interaction domain; wherein the first-type and third-type protein interaction domains bind specifically to each other.

Another aspect provided herein provides a composition comprising (a) a first polypeptide comprising a TCR recognition domain and a first-type protein interaction domain; and (b) a signaling polypeptide comprising a second-type protein interaction domain and an intracellular signaling domain; and (c) a recognition polypeptide comprising a second recognition domain and a third-type protein interaction domain; wherein the second-type and third-type protein interaction domains compete for binding to the first-type protein interaction domain.

In one embodiment of any aspect, the third-type protein interaction domain and first-type protein interaction domain have a higher affinity for each other than the second-type protein interaction domain and first-type protein interaction domain.

Another aspect provided herein provides a composition comprising (a) a first polypeptide comprising a TCR recognition domain and a first-type protein interaction domain; (b) a signaling polypeptide comprising a second-type protein interaction domain, a fourth-type protein interaction domain, and an intracellular signaling domain; and (c) a recognition polypeptide comprising a second recognition domain and a fifth-type protein interaction domain; wherein the first-type protein interaction domain and the second-type protein interaction domain bind specifically to each other; and wherein the fourth-type protein interaction domain and the fifth-type protein interaction domain bind specifically to each other.

In one embodiment of any aspect, the fourth-type protein interaction domain and fifth-type protein interaction domain have a weaker affinity than the second-type protein interaction domain and first-type protein interaction domain.

In one embodiment of any aspect, the first polypeptide further comprises a sixth-type protein interaction domain and the recognition polypeptide further comprises a seventh-type protein interaction domain which bind specifically to each other.

In one embodiment of any aspect, the second recognition domain is specific for a target that is not recognized by the TCR recognition domain.

In one embodiment of any aspect, the second recognition domain is specific for a target that is found on a healthy and/or non-target cell and not on a diseased and/or target cell.

TCR recognition domains may not comprise a single polypeptide, but rather comprise two or more polypeptides and may additionally even comprise non-polypeptides. For example, a single MHC class II tetramer TCR recognition domain can comprise 4 biotin small molecules and 16 polypeptides (4 peptides, 4 MHC class II alpha chains, 4 MHC class II beta chains, and 4 streptavidin proteins. Other types of TCR recognition domains may additionally comprise other non-polypeptide molecules (e.g., MHC dextramers contain a polysaccharide backbone to which the MI-ICs are anchored to). In some embodiments, a composition described herein can comprise multiple copies or instances of a TCR recognition domain(s), e.g. the TCR recognition domain can be a multimer, or oligomer. In some embodiments, a composition described herein can comprise multiple copies or instances of a first polypeptide as described herein. In some embodiments, the first polypeptide comprises the entire TCR recognition domain. In some embodiments, the TCR recognition domain comprises at least two separate polypeptide sequences, the first polypeptide comprises at least one of the separate polypeptide sequences of the TCR recognition domain, and the first polypeptide is bound to or complexed with a second or further polypeptide sequences of the TCR recognition domain to form a TCR recognition domain.

In one embodiment of any aspect, the TCR recognition domain comprises a MHC (Major Histocompatibility Complex); a MHC-peptide complex; or a MHC-peptide fusion.

In one embodiment of any aspect, the peptide is a human, non-human, or synthetic/engineered peptide. The peptides can further comprise non-proteinaceous motifs, modifications, or domains, e.g., they can comprise glycosylation and/or lipids. In one embodiment of any aspect, the peptide is a Minor Histocompatibility Antigen (MiHA).

In one embodiment of any aspect, the MHC is a monomer, dimer, trimer, tetramer, pentamer, dextramer or other oligomer form.

In one embodiment of any aspect, the protein interaction domains are found on an extracellular portion of the respective polypeptides.

In one embodiment of any aspect, (a) the protein interaction domain(s) is a leucine zipper, or any binding pair of protein interaction domains are collectively a pair of leucine zippers; (b) the protein interaction domain(s) is a BZip (RR) and/or a AZip (EE), or any binding pair of protein interaction domains are collectively a BZip (RR) and a AZip (EE); (c) the protein interaction domain(s) is a PSD95-Dlg1-zo-1 (PDZ) domain; (d) the protein interaction domain(s) is a streptavidin and/or a streptavidin binding protein (SBP) or any binding pair of protein interaction domains are collectively a streptavidin and a streptavidin binding protein (SBP); (e) the protein interaction domain(s) is a FKBP-binding domain of mTOR (FRB) and/or a FK506 binding protein (FKBP) or any binding pair of protein interaction domains are collectively a FKBP-binding domain of mTOR (FRB) and a FK506 binding protein (FKBP); (f) the protein interaction domain(s) is a cyclophilin-Fas fusion protein (CyP-Fas) and/or a FK506 binding protein (FKBP) or any binding pair of protein interaction domains are collectively a cyclophilin-Fas fusion protein (CyP-Fas) and a FK506 binding protein (FKBP); (g) the protein interaction domain(s) is a calcineurin A (CNA) and/or a FK506 binding protein (FKBP) or any binding pair of protein interaction domains are collectively a calcineurin A (CNA) and a FK506 binding protein (FKBP); (h) the protein interaction domain(s) is a gibberellin insensitive (GIA) and/or a gibberellin insensitive dwarf1 (GID1) or any binding pair of protein interaction domains are collectively a gibberellin insensitive (GIA) and a gibberellin insensitive dwarf1 (GID1); (i) the protein interaction domain(s) is a Snap-tag and/or a Halo tag, or any binding pair of protein interaction domains are collectively a Snap-tag and a Halo tag; (j) the protein interaction domain(s) is a T14-3-3-cdeltaC and/or a C-Terminal peptides of PMA2 (CT52), or any binding pair of protein interaction domains are collectively a T14-3-3-cdeltaC and a C-Terminal peptides of PMA2 (CT52); (k) the protein interaction domain(s) is a PYL and/or a ABI, or any binding pair of protein interaction domains are collectively a PYL and a ABI; (l) the protein interaction domain(s) is a nucleotide tag and/or a zinc finger domain, or any binding pair of protein interaction domains are collectively a nucleotide tag and a zinc finger domain; (m) wherein the biomolecular interaction domain(s) is a nucleotide tag, or any binding pair of biomolecular interaction domains are collectively a pair of nucleotide tags; (n) the protein interaction domain(s) is a Fluorescein isothiocyanate (FITC) and/or a FITC binding protein or any binding pair of protein interaction domains are collectively a FITC and a FITC binding protein; and/or (o) the protein interaction domain(s) is a (R)-Phycoerythrin (R-PE/PE) and/or a R-PE/PE binding protein or any binding pair of protein interaction domains are collectively a FITC and a FITC binding protein.

In one embodiment of any aspect, the nucleotide tag is a DNA tag or dsDNA tag.

In one embodiment of any aspect, the intracellular signaling domain is a signaling domain from a protein selected from the group consisting of: TCRλ, FcRγ, FcRβ, CD3γ; CD3δ; CD3λ; CD3C; CD22; CD79a; CD79b; CD66d; CARD11; CD2; CD7; CD27; CD28; CD30; CD40; CD54

(ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; and ZAP70.

In one embodiments of any aspect, a cell comprising and/or expressing a comprising a composition comprising a TCR recognition domain and an intracellular signaling domain further comprises a TCR signaling-responsive promoter operatively linked to a payload transgene. Such embodiments permit transgene payload expression specifically to and/or in the vicinity of a targeted T cell. Suitable promoters and transgene are known in the art, e.g., those promoters and transgenes used in "TRUCK CAR" technology. An exemplary promoter is a NFAT-sensitive promoter. Exemplary transgene payloads can include checkpoint inhibitors (e.g., CTLA-4, [Ipilimumab, Tremelimumab] or PD-1 [Nivolumab, Pembrolizumab, Pidilizumab]) or proinflammatory cytokines (e.g., IL-2, IL-12, etc). In our case this will be used for in-situ targeting of a patient's anticancer T-cells to very specifically and locally deliver activating agents like one or more checkpoint inhibitors (CTLA-4, [Ipilimumab, Tremelimumab] or PD-1 [Nivolumab, Pembrolizumab, Pidilizumab]) and/or proinflammatory cytokines, (e.g. IL-2, IL-12, etc.) that can push them to expansion and effector phenotype. With this targeted delivery, it is expected to see more efficacy without the systemic side effects caused by checkpoint inhibitors and cytokines administered systemically. Further, combination therapy with multiple different agents is possible with the described technolog as there is minimal systemic side effect due to paracrine delivery. Further description of suitable promoters, payloads, as well as how to make and use TRUCK technology is described, e.g., Peterson et al. Front. Oncol. 2019 9:69; Chmielewski et al. Advances in Cell and Gene Therapy 2020 3:e84; Chimielewski et al. Expert opinion Biol Ther 2015 15:1145-54; and Chimieleski et al. Immunol Rev 2014 257:83-90; each of which is incorporated by reference herein in its entirety. In some embodiments, the cell can be allogeneic, e.g., and engineered once and given as pulse therapy. In some embodiments, the cell can be a T cell or any other cell type described herein, e.g., a NK cell. Exemplary, non-limiting proinflammatory cytokines include IFNs, IFN-γ, TNFα, TGF-β, IL-1β, IL-6, IL-4, IL-10, IL-13, IL-2, IL-12, IL-15, and IL-27.

A promoter can be said to drive expression or drive transcription of the nucleic acid sequence that it regulates. The phrases "operably linked," "operatively positioned," "operatively linked," "under control," and "under transcriptional control" indicate that a promoter is in a correct functional location and/or orientation in relation to a nucleic acid sequence it regulates to control transcriptional initiation and/or expression of that sequence.

In some embodiments, a composition comprising a TCR recognition domain and an biomolecular interaction domain is a soluble molecule and/or soluble complex.

Another aspect provided herein is a cell comprising and/or expressing the composition of any of the compositions described herein.

In one embodiment of any aspect, the TCR recognition domain comprises a MHC allogeneic to the cell comprising and/or expressing the composition. In one embodiment of any aspect, the TCR recognition domain comprises a MHC allogeneic to the cell that the TCR originated from.

In one embodiment of any aspect, the TCR recognition domain comprises a peptide allogeneic to the cell comprising and/or expressing the composition. In one embodiment of any aspect, the TCR recognition domain comprises a peptide allogeneic to the cell that the TCR originated from.

In one embodiment of any aspect, the cell is a dendritic cell (CAL DC), a T cell (e.g., effector, regulatory, etc.,) (CAL-T); regulatory T cell, effector T cell, natural killer cell (CAL NK), or any other myeloid cell. In one embodiment of any aspect, the cell is engineered to express the polypeptide(s) of the composition. In one embodiment of any aspect, the cell is engineered to express the signaling polypeptide of the composition. In one embodiment of any aspect, the cell is further engineered to knockout the native MHCI/II. In one embodiment of any aspect, the cell is further engineered to lack cell surface expression of native MHCI/II.

Another aspect provided herein is a chimeric antigen receptor (CAR) comprising (a) an anti-CD127 and/or anti-CD45RO recognition domain; and (b) an intracellular signaling domain.

Another aspect provided herein is a composition comprising a first polypeptide comprising: (a) an anti-CD127 and/or anti-CD45RO recognition domain; (b) a first-type protein interaction domain; and a second polypeptide comprising (a) a second-type protein interaction domain; and (b) an intracellular signaling domain; wherein the first-type protein interaction domain and the second-type protein interaction domain bind specifically to each other.

Another aspect provided herein is a composition comprising a first polypeptide comprising (a) an anti-CD127 recognition domain; (b) a first-type protein interaction domain; a second polypeptide comprising (a) an anti-CD45RO recognition domain; (b) a fifth-type protein interaction domain; and a third polypeptide comprising (a) a second-type and a fourth-type protein interaction domain; and (b) an intracellular signaling domain; wherein the first-type protein interaction domain and the second-type protein interaction domain bind specifically to each other; and wherein the fourth-type protein interaction domain and the fifth-type protein interaction domain bind specifically to each other.

Another aspect provided herein is a cell comprising any of the CARs described herein, or any of the compositions described herein.

Another aspect provided herein is a method of preventing and/or treating an autoimmune diseases or conditions or T cell mediated inflammation or immune response; or treating or preventing transplant rejection or GvHD in a subject in need thereof, the method comprising administering to the subject any of the compositions and/or cells described herein. Another aspect provided herein is a method of preventing and/or treating a malignant T cell condition in a subject in need thereof, the method comprising administering to the subject any of the compositions and/or cells described herein.

In various embodiments of any aspect, the TCR recognition domain comprises a MHC allogeneic to the subject, a MHC autologous to the transplant cells, a peptide allogeneic to the subject, or a peptide autologous to the transplant cells.

In one embodiment of any aspect, the transplant is vascularized composite allotransplantation (VCA).

In one embodiment of any aspect, the autoimmune disease is type 1 diabetes, multiple sclerosis, rheumatoid arthritis, or scleroderma.

One aspect of the embodiments provided herein is a CAR T cell that targets a CD127+/CD45RO+ T cell. In one embodiment, the CD127+/CD45RO+ T cell is a CD127+/CD45RO+ memory T cell. In one embodiment, the CD127+/CD45RO+ T cell is an alloreactive CD127+/CD45RO+ T cell.

Accordingly, one aspect herein provides a CAR comprising (a) an anti-CD127 and/or anti-CD45RO recognition domain; and (b) intracellular signaling domain. Further provided herein is a composition comprising (a) an anti-CD127 and/or anti-CD45RO recognition domain; and (b) intracellular signaling domain.

Another aspect of the provides a composition comprising a first polypeptide comprising: (a) an anti-CD127 and/or anti-CD45RO recognition domain; (b) a first-type protein interaction domain; and a second polypeptide comprising: (c) a second-type protein interaction domain; and (d) an intracellular signaling domain; wherein the first-type protein interaction domain and the second-type protein interaction domain bind specifically to each other.

Another aspect of the provides a composition comprising a first polypeptide comprising: (a) an anti-CD127 recognition domain; (b) a first-type protein interaction domain; a second polypeptide comprising: (c) an anti-CD45RO recognition domain; (d) a fifth-type protein interaction domain; and a third polypeptide comprising: (e) a second-type and a fourth-type protein interaction domain; and (f) an intracellular signaling domain; wherein the first-type protein interaction domain and the second-type protein interaction domain bind specifically to each other; and wherein the fourth-type protein interaction domain and the fifth-type protein interaction domain bind specifically to each other.

In one embodiment, the anti-CD127 recognition domain recognizes and binds to the sequence of CD127 on a CD127+ cell, e.g., a CD127+/CD45RO+ T cell. As used herein, "CD127", also referred to as Interleukin 7 receptor a (IL7Ra), ILRA, IL7RA, CDW127, or IL-7R-alpha, is a cell surface receptor that has been shown to have a role in V(D)J recombination during lymphocyte development. Defects in CD127 have been associated with severe combined immunodeficiency (SCID). Sequences for CD127 are known for a number of species, e.g., human CD127 (NCBI Gene ID: 3575), mRNA (NCBI Ref Seq: NM 002185.5), and polypeptide (NCBI Ref Seq: NP_002176.2). CD127 refers to all naturally occurring variants or isoforms of CD127. In one embodiment, the CD127 polypeptide sequence is presented in SEQ ID NO: 1. In some embodiments of any of the aspects, the CD127 polypeptide can be an ortholog, variant, and/or allele of SEQ ID NO: 1.

```
                                              (SEQ ID NO: 1)
  1 MTILGTTFGM VFSLLQVVSG ESGYAQNGDL EDAELDDYSF
    SCYSQLEVNG SQHSLTCAFE

61 DPDVNITNLE FEICGALVEV KCLNFRKLQE IYFIETKKFL
    LIGKSNICVK VGEKSLTCKK

121 IDLTTIVKPE APFDLSVVYR EGANDFVVTF NTSHLQKKYV
    KVLMHDVAYR QEKDENKWTH

181 VNLSSTKLTL LQRKLQPAAM YEIKVRSIPD HYFKGFWSEW
    SPSYYFRTPE INNSSGEMDP

241 ILLTISILSF FSVALLVILA CVLWKKRIKP IVWPSLPDHK
    KTLEHLCKKP RKNLNVSFNP

301 ESFLDCQIHR VDDIQARDEV EGFLQDTFPQ QLEESEKQRL
    GGDVQSPNCP SEDVVITPES

361 FGRDSSLTCL AGNVSACDAP ILSSSRSLDC RESGKNGPHV
    YQDLLLSLGT TNSTLPPPFS

421 LQSGILTLNP VAQGQPILTS LGSNQEEAYV TMSSFYQNQ
```

In one embodiment, the anti-CD45RO recognition domain recognizes and binds to the sequence of CD45RO on a CD45RO+ cell, e.g., a CD127+/CD45RO+ T cell. As used herein, "CD45RO", also referred to as PTPRC, LCA, LY5, B220, CD45, L-CA, T200, CD45R, and GP180, is to a cell surface signaling molecule that been shown to be an essential regulator of T- and B-cell antigen receptor signaling. Sequences for CD45RO are known for a number of species, e.g., human CD45RO (NCBI Gene ID: 5788), mRNA (NCBI Ref Seq: NM_001267798.2), and polypeptide (NCBI Ref Seq: NP_001254727.1). CD45RO refers to all naturally occurring variants or isoforms of CD45RO. In one embodiment, the CD45RO polypeptide sequence is presented in SEQ ID NO: 2. In some embodiments of any of the aspects, the CD45RO polypeptide can be an ortholog, variant, and/or allele of SEQ ID NO: 2.

```
                                              (SEQ ID NO: 2)
  1 MTMYLWLKLL AFGFAFLDTE VFVTGQSPTP SPTGHLQAEE
    QGSQSKSPNL KSREADSSAF

61 SWWPKAREPL TNHWSKSKSP KAEELGV
```

For convenience, the meaning of some terms and phrases used in the specification, examples, and appended claims, are provided below. Unless stated otherwise, or implicit from context, the following terms and phrases include the meanings provided below. The definitions are provided to aid in describing particular embodiments, and are not intended to limit the claimed invention, because the scope of the invention is limited only by the claims. Unless otherwise defined, all technical and scientific terms used herein have the same meaning as commonly understood by one of ordinary skill in the art to which this invention belongs. If there is an apparent discrepancy between the usage of a term in the art and its definition provided herein, the definition provided within the specification shall prevail.

For convenience, certain terms employed herein, in the specification, examples and appended claims are collected here.

The terms "decrease", "reduced", "reduction", or "inhibit" are all used herein to mean a decrease by a statistically significant amount. In some embodiments, "reduce," "reduction" or "decrease" or "inhibit" typically means a decrease by at least 10% as compared to a reference level (e.g. the absence of a given treatment) and can include, for example, a decrease by at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 98%, at least about 99%, or more. As used herein, "reduction" or "inhibition" does not encompass a complete inhibition or reduction as compared to a reference level. "Complete inhibition" is a 100% inhibition as compared to a reference level. A decrease can be preferably down to a level accepted as within the range of normal for an individual without a given disorder.

The terms "increased", "increase", "enhance", or "activate" are all used herein to mean an increase by a statically significant amount. In some embodiments, the terms "increased", "increase", "enhance", or "activate" can mean an increase of at least 10% as compared to a reference level, for example an increase of at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, or at least about a 2-fold, or at least about a 3-fold, or at least about a 4-fold, or at least about a 5-fold or at least about a 10-fold increase, or any increase between 2-fold and 10-fold or greater as compared to a reference level. In the context of a marker or symptom, a "increase" is a statistically significant increase in such level.

As used herein, a "subject" means a human or animal. Usually the animal is a vertebrate such as a swine, primate, rodent, domestic animal or game animal. Primates include chimpanzees, cynomolgus monkeys, spider monkeys, and macaques, e.g., Rhesus. Rodents include mice, rats, woodchucks, ferrets, rabbits and hamsters. Domestic and game animals include cows, horses, pigs, deer, bison, buffalo, feline species, e.g., domestic cat, canine species, e.g., dog, fox, wolf, avian species, e.g., chicken, emu, ostrich, and fish, e.g., trout, catfish and salmon. In some embodiments, the subject is a mammal, e.g., a primate, e.g., a human. The terms, "individual," "patient" and "subject" are used interchangeably herein.

Preferably, the subject is a mammal. The mammal can be a human, non-human swine, primate, mouse, rat, dog, cat, horse, or cow, but is not limited to these examples. Mammals other than humans can be advantageously used as subjects that represent animal models of autoimmune diseases or conditions; T cell mediated inflammation or immune response; malignant T cell condition; transplant rejection; or GvHD. A subject can be male or female.

A subject can be one who has been previously diagnosed with or identified as suffering from or having a condition in need of treatment (e.g. an autoimmune disease or condition; T cell mediated inflammation or immune response; malignant T cell condition; transplant rejection; or GvHD) or one or more complications related to such a condition, and optionally, have already undergone treatment for an autoimmune disease or condition; T cell mediated inflammation or immune response; malignant T cell condition; transplant rejection; or GvHD or the one or more complications related to an autoimmune disease, transplant rejection, or GvHD. Alternatively, a subject can also be one who has not been previously diagnosed as having an autoimmune disease or condition; T cell mediated inflammation or immune response; malignant T cell condition; transplant rejection; or GvHD or one or more complications related to an autoimmune disease or condition; T cell mediated inflammation or immune response; malignant T cell condition; transplant rejection; or GvHD. For example, a subject can be one who exhibits one or more risk factors for an autoimmune disease or condition; T cell mediated inflammation or immune response; malignant T cell condition; transplant rejection; or GvHD or one or more complications related to an autoimmune disease or condition; T cell mediated inflammation or immune response; malignant T cell condition; transplant rejection; or GvHD or a subject who does not exhibit risk factors.

A "subject in need" of treatment for a particular condition can be a subject having that condition, diagnosed as having that condition, or at risk of developing that condition, e.g., an autoimmune disease or condition; T cell mediated inflammation or immune response; malignant T cell condition; transplant rejection; or GvHD.

In some embodiments, a nucleic acid encoding a CAL, CAR, a multi-component CAL and/or CAR or portion thereof as described herein is comprised by a vector. In some of the aspects described herein, a nucleic acid sequence encoding a multi-component CAL and/or CAR, or portion thereof as described herein, or any module thereof, is operably linked to a vector. The term "vector", as used herein, refers to a nucleic acid construct designed for delivery to a host cell or for transfer between different host cells. As used herein, a vector can be viral or non-viral. The term "vector" encompasses any genetic element that is capable of replication when associated with the proper control elements and that can transfer gene sequences to cells. A vector can include, but is not limited to, a cloning vector, an expression vector, a plasmid, phage, transposon, cosmid, chromosome, virus, virion, etc.

As used herein, the term "expression vector" refers to a vector that directs expression of an RNA or polypeptide from sequences linked to transcriptional regulatory sequences on the vector. The sequences expressed will often, but not necessarily, be heterologous to the cell. An expression vector may comprise additional elements, for example, the expression vector may have two replication systems, thus allowing it to be maintained in two organisms, for example in human cells for expression and in a prokaryotic host for cloning and amplification. The term "expression" refers to the cellular processes involved in producing RNA and proteins and as appropriate, secreting proteins, including where applicable, but not limited to, for example, transcription, transcript processing, translation and protein folding, modification and processing. "Expression products" include RNA transcribed from a gene, and polypeptides obtained by translation of mRNA transcribed from a gene. The term "gene" means the nucleic acid sequence that is transcribed (DNA) to RNA in vitro or in vivo when operably linked to appropriate regulatory sequences. The gene may or may not include regions preceding and following the coding region, e.g. 5' untranslated (5'UTR) or "leader" sequences and 3' UTR or "trailer" sequences, as well as intervening sequences (introns) between individual coding segments (exons).

As used herein, the term "viral vector" refers to a nucleic acid vector construct that includes at least one element of viral origin and has the capacity to be packaged into a viral vector particle. The viral vector can contain the nucleic acid encoding a CAL and/or CAR described herein, e.g., a multi-component CAL and/or CAR, or portion thereof as described herein in place of non-essential viral genes. The vector and/or particle may be utilized for the purpose of transferring any nucleic acids into cells either in vitro or in vivo. Numerous forms of viral vectors are known in the art.

By "recombinant vector" is meant a vector that includes a heterologous nucleic acid sequence, or "transgene" that is capable of expression in vivo or in the transduced cells. It should be understood that the vectors described herein can, in some embodiments, be combined with other suitable compositions and therapies. In some embodiments, the vector is episomal. The use of a suitable episomal vector provides a means of maintaining the nucleotide of interest in the subject in high copy number extra chromosomal DNA thereby eliminating potential effects of chromosomal integration.

As used herein, the term "nucleic acid" or "nucleic acid sequence" refers to any molecule, preferably a polymeric molecule, incorporating units of ribonucleic acid, deoxyribonucleic acid or an analog thereof. The nucleic acid can be either single-stranded or double-stranded. A single-stranded nucleic acid can be one nucleic acid strand of a denatured double-stranded DNA. Alternatively, it can be a single-stranded nucleic acid not derived from any double-stranded DNA. In one aspect, the nucleic acid can be DNA. In another aspect, the nucleic acid can be RNA, e.g., single-stranded or double-stranded RNA. Suitable nucleic acid molecules are DNA, including genomic DNA or cDNA. Other suitable nucleic acid molecules are RNA, including mRNA.

As used herein, the terms "protein" and "polypeptide" are used interchangeably herein to designate a series of amino acid residues, connected to each other by peptide bonds between the alpha-amino and carboxy groups of adjacent residues. The terms "protein", and "polypeptide" refer to a polymer of amino acids, including modified amino acids (e.g., phosphorylated, glycated, glycosylated, etc.) and amino acid analogs, regardless of its size or function. "Protein" and "polypeptide" are often used in reference to relatively large polypeptides, whereas the term "peptide" is often used in reference to small polypeptides, but usage of these terms in the art overlaps. The terms "protein" and "polypeptide" are used interchangeably herein when referring to a gene product and fragments thereof. Thus, exemplary polypeptides or proteins include gene products, naturally occurring proteins, homologs, orthologs, paralogs, fragments and other equivalents, variants, fragments, and analogs of the foregoing.

As used herein an "antibody" refers to IgG, IgM, IgA, IgD or IgE molecules or antigen-specific antibody fragments thereof (including, but not limited to, a Fab, F(ab')2, Fv, disulphide linked Fv, scFv, single domain antibody, closed conformation multispecific antibody, disulphide-linked scfv, diabody), whether derived from any species that naturally produces an antibody, or created by recombinant DNA technology; whether isolated from serum, B-cells, hybridomas, transfectomas, yeast or bacteria.

As described herein, an "antigen" is a molecule that is bound by a binding site on an antibody agent. Typically, antigens are bound by antibody ligands and are capable of raising an antibody response in vivo. An antigen can be a polypeptide, protein, nucleic acid or other molecule or portion thereof. The term "antigenic determinant" refers to an epitope on the antigen recognized by an antigen-binding molecule, and more particularly, by the antigen-binding site of said molecule.

As used herein, the term "antibody reagent" refers to a polypeptide that includes at least one immunoglobulin variable domain or immunoglobulin variable domain sequence and which specifically binds a given antigen. An antibody reagent can comprise an antibody or a polypeptide comprising an antigen-binding domain of an antibody. In some embodiments, an antibody reagent can comprise a monoclonal antibody or a polypeptide comprising an antigen-binding domain of a monoclonal antibody. For example, an antibody can include a heavy (H) chain variable region (abbreviated herein as VH), and a light (L) chain variable region (abbreviated herein as VL). In another example, an antibody includes two heavy (H) chain variable regions and two light (L) chain variable regions. The term "antibody reagent" encompasses antigen-binding fragments of antibodies (e.g., single chain antibodies, Fab and sFab fragments, F(ab')2, Fd fragments, Fv fragments, scFv, and domain antibodies (dAb) fragments (see, e.g. de Wildt et al., Eur J. Immunol. 1996; 26(3):629-39; which is incorporated by reference herein in its entirety)) as well as complete antibodies. An antibody can have the structural features of IgA, IgG, IgE, IgD, IgM (as well as subtypes and combinations thereof). Antibodies can be from any source, including mouse, rabbit, pig, rat, and primate (human and non-human primate) and primatized antibodies. Antibodies also include midibodies, humanized antibodies, chimeric antibodies, and the like.

The VH and VL regions can be further subdivided into regions of hypervariability, termed "complementarity determining regions" ("CDR"), interspersed with regions that are more conserved, termed "framework regions" ("FR"). The extent of the framework region and CDRs has been precisely defined (see, Kabat, E. A., et al. (1991) Sequences of Proteins of Immunological Interest, Fifth Edition, U.S. Department of Health and Human Services, NIH Publication No. 91-3242, and Chothia, C. et al. (1987) J. Mol. Biol. 196:901-917; which are incorporated by reference herein in their entireties). Each VH and VL is typically composed of three CDRs and four FRs, arranged from amino-terminus to carboxy-terminus in the following order: FR1, CDR1, FR2, CDR2, FR3, CDR3, FR4.

The terms "antigen-binding fragment" or "antigen-binding domain", which are used interchangeably herein are used to refer to one or more fragments of a full length antibody that retain the ability to specifically bind to a target of interest. Examples of binding fragments encompassed within the term "antigen-binding fragment" of a full length antibody include (i) a Fab fragment, a monovalent fragment consisting of the VL, VH, CL and CH1 domains; (ii) a F(ab')2 fragment, a bivalent fragment including two Fab fragments linked by a disulfide bridge at the hinge region; (iii) an Fd fragment consisting of the VH and CH1 domains; (iv) an Fv fragment consisting of the VL and VH domains of a single arm of an antibody, (v) a dAb fragment (Ward et al., (1989) Nature 341:544-546; which is incorporated by reference herein in its entirety), which consists of a VH or VL domain; and (vi) an isolated complementarity determining region (CDR) that retains specific antigen-binding functionality.

As used herein, the term "specific binding" refers to a chemical interaction between two molecules, compounds, cells and/or particles wherein the first entity binds to the second, target entity with greater specificity and affinity than it binds to a third entity which is a non-target. In some embodiments, specific binding can refer to an affinity of the first entity for the second target entity which is at least 10 times, at least 50 times, at least 100 times, at least 500 times, at least 1000 times or greater than the affinity for the third nontarget entity. A reagent specific for a given target is one that exhibits specific binding for that target under the conditions of the assay being utilized. In some embodiments, binding described herein can be preferential binding, e.g., binding between two molecules, compounds, cells and/or particles wherein the first entity binds to the second, target entity with at least 2 times greater specificity and affinity than it binds to a third entity which is a non-target.

Additionally, and as described herein, a recombinant humanized antibody can be further optimized to decrease potential immunogenicity, while maintaining functional activity, for therapy in humans. In this regard, functional activity means a polypeptide capable of displaying one or more known functional activities associated with a recombinant antibody or antibody reagent thereof as described herein. Such functional activities include, e.g. the ability to bind to a target.

As used herein, the terms "treat," "treatment," "treating," or "amelioration" refer to therapeutic treatments, wherein the object is to reverse, alleviate, ameliorate, inhibit, slow down or stop the progression or severity of a condition associated with a disease or disorder, e.g. autoimmune disease or condition; T cell mediated inflammation or immune response; malignant T cell condition; transplant rejection; or GvHD. The term "treating" includes reducing or alleviating at least one adverse effect or symptom of a condition, disease or disorder associated with a, e.g. autoimmune disease or condition; T cell mediated inflammation or immune response; malignant T cell condition; transplant rejection; or GvHD. Treatment is generally "effective" if one or more symptoms or clinical markers are reduced. Alternatively, treatment is "effective" if the progression of a disease is reduced or halted. That is, "treatment" includes not just the improvement of symptoms or markers, but also a cessation of, or at least slowing of, progress or worsening of symptoms compared to what would be expected in the absence of treatment. Beneficial or desired clinical results include, but are not limited to, alleviation of one or more symptom(s), diminishment of extent of disease, stabilized (i.e., not worsening) state of disease, delay or slowing of disease progression, amelioration or palliation of the disease state, remission (whether partial or total), and/or decreased mortality, whether detectable or undetectable. The term "treatment" of a disease also includes providing relief from the symptoms or side-effects of the disease (including palliative treatment).

As used herein, the term "pharmaceutical composition" refers to the active agent in combination with a pharmaceutically acceptable carrier e.g. a carrier commonly used in the pharmaceutical industry. The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

As used herein, the term "administering," refers to the placement of an agent, e.g., a CAL, CAR, composition, or cell as disclosed herein into a subject by a method or route which results in at least partial delivery of the agent at a desired site. Pharmaceutical compositions comprising the compounds disclosed herein can be administered by any appropriate route which results in an effective treatment in the subject.

Immune checkpoint inhibitors inhibit one or more immune checkpoint proteins. The immune system has multiple inhibitory pathways that are critical for maintaining self-tolerance and modulating immune responses. For example, in T-cells, the amplitude and quality of response is initiated through antigen recognition by the T-cell receptor and is regulated by immune checkpoint proteins that balance co-stimulatory and inhibitory signals. In some embodiments of any of the aspects, a subject or patient is treated with at least one inhibitor of an immune checkpoint protein. As used herein, "immune checkpoint protein" refers to a protein which, when active, exhibits an inhibitory effect on immune activity, e.g., T cell activity. Exemplary immune checkpoint proteins can include PD-1 (e.g., NCBI Gene ID: 5133); PD-L1 (e.g., NCBI Gene ID: 29126); PD-L2 (e.g., NCBI Gene ID: 80380); TIM-3 (e.g., NCBI Gene ID: 84868); CTLA4 (e.g., NCBI Gene ID: 1493); TIGIT (e.g., NCBI Gene ID: 201633); KIR (e.g., NCBI Gene ID: 3811); LAG3 (e.g., NCBI Gene ID: 3902); DD1-α (e.g., NCBI Gene ID: 64115); A2AR (e.g., NCBI Gene ID: 135); B7-H3 (e.g., NCBI Gene ID: 80381); B7-H4 (e.g., NCBI Gene ID: 79679); BTLA (e.g., NCBI Gene ID: 151888); IDO (e.g., NCBI Gene ID: 3620); TDO (e.g., NCBI Gene ID: 6999); HVEM (e.g., NCBI Gene ID: 8764); GALS (e.g., NCBI Gene ID: 3965); 2B4 (belongs to the CD2 family of molecules and is expressed on all NK, γδ, and memory CD8+(4) T cells) (e.g., NCBI Gene ID: 51744); CD160 (also referred to as BY55) (e.g., NCBI Gene ID: 11126); and various B-7 family ligands. B7 family ligands include, but are not limited to, B7-1, B7-2, B7-DC, B7-H1, B7-H2, B7-H3, B7-H4, B7-H5, B7-H6 and B7-H7.

Non-limiting examples of immune checkpoint inhibitors (with checkpoint targets and manufacturers noted in parantheses) can include: MGA271 (B7-H3: MacroGenics); ipilimumab (CTLA-4; Bristol Meyers Squibb); pembrolizumab (PD-1; Merck); nivolumab (PD-1; Bristol Meyers Squibb); atezolizumab (PD-L1; Genentech); galiximab (B7.1; Biogen); IMP321 (LAG3: Immuntep); BMS-986016 (LAG3; Bristol Meyers Squibb); SMB-663513 (CD137; Bristol-Meyers Squibb); PF-05082566 (CD137; Pfizer); IPH2101 (KIR; Innate Pharma); KW-0761 (CCR4; Kyowa Kirin); CDX-1127 (CD27; CellDex); MEDI-6769 (Ox40; MedImmune); CP-870,893 (CD40; Genentech); tremelimumab (CTLA-4; Medimmune); pidilizumab (PD-1; Medivation); MPDL3280A (PD-L1; Roche); MEDI4736 (PD-L1; AstraZeneca); MSB0010718C (PD-L1; EMD Serono); AUNP12 (PD-1; Aurigene); avelumab (PD-L1; Merck); durvalumab (PD-L1; Medimmune); IMP321, a soluble Ig fusion protein (Brignone et al., 2007, J. Immunol. 179:4202-4211); the anti-B7-H3 antibody MGA271 (Loo et al., 2012, Clin. Cancer Res. July 15 (18) 3834); TIM3 (T-cell immunoglobulin domain and mucin domain 3) inhibitors (Fourcade et al., 2010, J. Exp. Med. 207:2175-86 and Sakuishi et al., 2010, J. Exp. Med. 207:2187-94); anti-CTLA-4 antibodies described in U.S. Pat. Nos. 5,811,097; 5,811,097; 5,855,887; 6,051,227; 6,207,157; 6,682,736; 6,984,720; and 7,605,238; tremelimumab, (ticilimumab, CP-675,206); ipilimumab (also known as 10D1, MDX-D010); PD-1 and PD-L1 blockers described in U.S. Pat. Nos. 7,488,802; 7,943,743; 8,008,449; 8,168,757; 8,217,149, and PCT Published Patent Application Nos: WO03042402, WO2008156712, WO2010089411, WO2010036959, WO2011066342, WO2011159877, WO2011082400, and WO2011161699; nivolumab (MDX 1106, BMS 936558, ONO 4538); lambrolizumab (MK-3475 or SCH 900475); CT-011; AMP-224; and BMS-936559 (MDX-1105-01). The foregoing references are incorporated by reference herein in their entireties.

The term "statistically significant" or "significantly" refers to statistical significance, e.g., a rejection of the null hypothesis with a p-value of less than 0.05 and generally means a two standard deviation (2SD) or greater difference.

Other than in the operating examples, or where otherwise indicated, all numbers expressing quantities of ingredients or reaction conditions used herein should be understood as modified in all instances by the term "about." The term "about" when used in connection with percentages can mean±1%.

As used herein the term "comprising" or "comprises" is used in reference to compositions, methods, and respective component(s) thereof, that are essential to the method or composition, yet open to the inclusion of unspecified elements, whether essential or not.

The term "consisting of" refers to compositions, methods, and respective components thereof as described herein, which are exclusive of any element not recited in that description of the embodiment.

As used herein the term "consisting essentially of" refers to those elements required for a given embodiment. The term permits the presence of elements that do not materially affect the basic and novel or functional characteristic(s) of that embodiment.

The singular terms "a," "an," and "the" include plural referents unless context clearly indicates otherwise. Similarly, the word "or" is intended to include "and" unless the context clearly indicates otherwise. Although methods and materials similar or equivalent to those described herein can be used in the practice or testing of this disclosure, suitable methods and materials are described below. The abbreviation, "e.g." is derived from the Latin exempli gratia and is used herein to indicate a non-limiting example. Thus, the abbreviation "e.g." is synonymous with the term "for example."

Unless otherwise defined herein, scientific and technical terms used in connection with the present application shall have the meanings that are commonly understood by those of ordinary skill in the art to which this disclosure belongs. It should be understood that this invention is not limited to the particular methodology, protocols, and reagents, etc., described herein and as such can vary. The terminology used herein is for the purpose of describing particular embodiments only and is not intended to limit the scope of the present invention, which is defined solely by the claims. Definitions of common terms in immunology and molecular biology can be found in The Merck Manual of Diagnosis and Therapy, 19th Edition, published by Merck Sharp & Dohme Corp., 2011 (ISBN 978-0-911910-19-3); Robert S. Porter et al. (eds.), The Encyclopedia of Molecular Cell Biology and Molecular Medicine, published by Blackwell Science Ltd., 1999-2012 (ISBN 9783527600908); and Robert A. Meyers (ed.), Molecular Biology and Biotechnology: a Comprehensive Desk Reference, published by VCH Publishers, Inc., 1995 (ISBN 1-56081-569-8); Immunology by Werner Luttmann, published by Elsevier, 2006; Janeway's Immunobiology, Kenneth Murphy, Allan Mowat, Casey Weaver (eds.), Taylor & Francis Limited, 2014 (ISBN 0815345305, 9780815345305); Lewin's Genes XI, published by Jones & Bartlett Publishers, 2014 (ISBN-1449659055); Michael Richard Green and Joseph Sambrook, Molecular Cloning: A Laboratory Manual, 4th ed., Cold Spring Harbor Laboratory Press, Cold Spring Harbor, N.Y., USA (2012) (ISBN 1936113414); Davis et al., Basic Methods in Molecular Biology, Elsevier Science Publishing, Inc., New York, USA (2012) (ISBN 044460149X); Laboratory Methods in Enzymology: DNA, Jon Lorsch (ed.) Elsevier, 2013 (ISBN 0124199542); Current Protocols in Molecular Biology (CPMB), Frederick M. Ausubel (ed.), John Wiley and Sons, 2014 (ISBN 047150338X, 9780471503385), Current Protocols in Protein Science (CPPS), John E. Coligan (ed.), John Wiley and Sons, Inc., 2005; and Current Protocols in Immunology (CPI) (John E. Coligan, ADA M Kruisbeek, David H Margulies, Ethan M Shevach, Warren Strobe, (eds.) John Wiley and Sons, Inc., 2003 (ISBN 0471142735, 9780471142737), the contents of which are all incorporated by reference herein in their entireties.

Other terms are defined herein within the description of the various aspects of the invention.

All patents and other publications; including literature references, issued patents, published patent applications, and co-pending patent applications; cited throughout this application are expressly incorporated herein by reference for the purpose of describing and disclosing, for example, the methodologies described in such publications that might be used in connection with the technology described herein. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

The description of embodiments of the disclosure is not intended to be exhaustive or to limit the disclosure to the precise form disclosed. While specific embodiments of, and examples for, the disclosure are described herein for illustrative purposes, various equivalent modifications are possible within the scope of the disclosure, as those skilled in the relevant art will recognize. For example, while method steps or functions are presented in a given order, alternative embodiments may perform functions in a different order, or functions may be performed substantially concurrently. The teachings of the disclosure provided herein can be applied to other procedures or methods as appropriate. The various embodiments described herein can be combined to provide further embodiments. Aspects of the disclosure can be modified, if necessary, to employ the compositions, functions and concepts of the above references and application to provide yet further embodiments of the disclosure. Moreover, due to biological functional equivalency considerations, some changes can be made in protein structure without affecting the biological or chemical action in kind or amount. These and other changes can be made to the disclosure in light of the detailed description. All such modifications are intended to be included within the scope of the appended claims.

Specific elements of any of the foregoing embodiments can be combined or substituted for elements in other embodiments. Furthermore, while advantages associated with certain embodiments of the disclosure have been described in the context of these embodiments, other embodiments may also exhibit such advantages, and not all embodiments need necessarily exhibit such advantages to fall within the scope of the disclosure.

All patents and other publications identified in the specification and examples are expressly incorporated herein by reference for all purposes. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

Although preferred embodiments have been depicted and described in detail herein, it will be apparent to those skilled in the relevant art that various modifications, additions, substitutions, and the like can be made without departing from the spirit of the invention and these are therefore considered to be within the scope of the invention as defined in the claims which follow. Further, to the extent not already indicated, it will be understood by those of ordinary skill in the art that any one of the various embodiments herein described and illustrated can be further modified to incorporate features shown in any of the other embodiments disclosed herein.

Some embodiments of the technology described herein can be defined according to any of the following numbered paragraphs:

1. A composition, comprising:
   a. a TCR recognition domain; and
   one or both of:
   b. an intracellular signaling domain; and
   c. a first-type protein interaction domain.
2. A composition comprising:
   a. a first polypeptide comprising a TCR recognition domain and a first-type protein interaction domain; and b. a signaling polypeptide comprising a second-type protein interaction domain and an intracellular signaling domain;
wherein the first-type and second-type protein interaction domains bind specifically to each other.

3. A composition comprising:
   a. a first polypeptide comprising a TCR recognition domain and a first-type protein interaction domain; and
   b. a recognition polypeptide comprising a second recognition domain and a third-type protein interaction domain;
   wherein the first-type and third-type protein interaction domains bind specifically to each other.

4. A composition comprising:
   a. a first polypeptide comprising a TCR recognition domain and a first-type protein interaction domain; and
   b. a signaling polypeptide comprising a second-type protein interaction domain and an intracellular signaling domain; and
   c. a recognition polypeptide comprising a second recognition domain and a third-type protein interaction domain;
   wherein the second-type and third-type protein interaction domains compete for binding to the first-type protein interaction domain.

5. The composition of any of paragraphs 3-4, wherein the third-type protein interaction domain and first-type protein interaction domain have a higher affinity for each other than the second-type protein interaction domain and first-type protein interaction domain.

6. A composition comprising:
   a. a first polypeptide comprising a TCR recognition domain and a first-type protein interaction domain;
   b. a signaling polypeptide comprising a second-type protein interaction domain, a fourth-type protein interaction domain, and an intracellular signaling domain; and
   c. a recognition polypeptide comprising a second recognition domain and a fifth-type protein interaction domain;
   wherein the first-type protein interaction domain and the second-type protein interaction domain bind specifically to each other; and
   wherein the fourth-type protein interaction domain and the fifth-type protein interaction domain bind specifically to each other.

7. The composition of paragraph 6, wherein the fourth-type protein interaction domain and fifth-type protein interaction domain have a weaker affinity than the second-type protein interaction domain and first-type protein interaction domain.

8. The composition of any of paragraphs 6-7, wherein the first polypeptide further comprises a sixth-type protein interaction domain and the recognition polypeptide further comprises a seventh-type protein interaction domain which bind specifically to each other.

9. The composition of any of paragraphs 3-8, wherein the second recognition domain is specific for a target that is not recognized by the TCR recognition domain.

10. The composition of any of paragraphs 3-9, wherein the second recognition domain is specific for a target that is found on a healthy and/or non-target cell and not on a diseased and/or target cell.

11. The composition of any of the preceding paragraphs, wherein the TCR recognition domain comprises a MHC (Major Histocompatibility Complex); a MHC-peptide complex; or a MHC-peptide fusion.

12. The composition of paragraph 11, wherein the peptide is a human or non-human peptide.

13. The composition of any of paragraphs 11-12, wherein the peptide is a Minor Histocompatibility Antigen (MiHA).

14. The composition of any of paragraphs 11-13, wherein the MHC is a monomer, dimer, trimer, tetramer, pentamer, dextramer or other oligomer form.

15. The composition of any of the preceding paragraphs, wherein the protein interaction domains are found on an extracellular portion of the respective polypeptides.

16. The composition of any of the preceding paragraphs,
    a. wherein the protein interaction domain(s) is a leucine zipper, or any binding pair of protein interaction domains are collectively a pair of leucine zippers;
    b. wherein the protein interaction domain(s) is a BZip (RR) and/or a AZip (EE), or any binding pair of protein interaction domains are collectively a BZip (RR) and a AZip (EE);
    c. wherein the protein interaction domain(s) is a PSD95-Dlg1-zo-1 (PDZ) domain;
    d. wherein the protein interaction domain(s) is a streptavidin and/or a streptavidin binding protein (SBP) or any binding pair of protein interaction domains are collectively a streptavidin and a streptavidin binding protein (SBP);
    e. wherein the protein interaction domain(s) is a FKBP-binding domain of mTOR (FRB) and/or a FK506 binding protein (FKBP) or any binding pair of protein interaction domains are collectively a FKBP-binding domain of mTOR (FRB) and a FK506 binding protein (FKBP);
    f. wherein the protein interaction domain(s) is a cyclophilin-Fas fusion protein (CyP-Fas) and/or a FK506 binding protein (FKBP) or any binding pair of protein interaction domains are collectively a cyclophilin-Fas fusion protein (CyP-Fas) and a FK506 binding protein (FKBP);
    g. wherein the protein interaction domain(s) is a calcineurinA (CNA) and/or a FK506 binding protein (FKBP) or any binding pair of protein interaction domains are collectively a calcineurinA (CNA) and a FK506 binding protein (FKBP);
    h. wherein the protein interaction domain(s) is a gibberellin insensitive (GIA) and/or a gibberellin insensitive dwarf1 (GID1) or any binding pair of protein interaction domains are collectively a gibberellin insensitive (GIA) and a gibberellin insensitive dwarf1 (GID1);
    i. wherein the protein interaction domain(s) is a Snap-tag and/or a Halo tag, or any binding pair of protein interaction domains are collectively a Snap-tag and a Halo tag;
    j. wherein the protein interaction domain(s) is a T14-3-3-cdeltaC and/or a C-Terminal peptides of PMA2 (CT52), or any binding pair of protein interaction domains are collectively a T14-3-3-cdeltaC and a C-Terminal peptides of PMA2 (CT52);
    k. wherein the protein interaction domain(s) is a PYL and/or a ABI, or any binding pair of protein interaction domains are collectively a PYL and a ABI; and/or
    l. wherein the protein interaction domain(s) is a nucleotide tag and/or a zinc finger domain, or any binding pair of protein interaction domains are collectively a nucleotide tag and a zinc finger domain.
17. The composition of paragraph 16, wherein the nucleotide tag is a DNA tag or dsDNA tag.
18. The composition of any of the preceding paragraphs, wherein the intracellular signaling domain is a signaling domain from a protein selected from the group consisting of:
TCRC; FcRγ; FcRp; CD3y; CD3S; CD3s; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; ZAP70; and 41BB.
19. A cell comprising and/or expressing the composition of any of the preceding paragraphs.
20. The cell of paragraph 19, wherein the TCR recognition domain comprises a MHC allogenic to the cell.
21. The cell of paragraph 19, wherein the TCR recognition domain comprises a peptide allogenic to the cell.
22. The cell of any of paragraphs 19-21, wherein the cell is a dendritic cell, regulatory T cell, or effector T cell.
23. The cell of any of paragraphs 19-22, wherein the cell is engineered to express the polypeptide(s) of the composition.
24. The cell of any of paragraphs 19-22, wherein the cell is engineered to express the signaling polypeptide of the composition.
25. The cell of any of paragraphs 19-24, wherein the cell is further engineered to knockout the native MHCI/II.
26. A chimeric antigen receptor (CAR) comprising:
   a. an anti-CD127 and/or anti-CD45RO recognition domain;
   b. an intracellular signaling domain.
27. A composition comprising:
   a first polypeptide comprising:
   a. an anti-CD127 and/or anti-CD45RO recognition domain;
   b. a first-type protein interaction domain; and
   a second polypeptide comprising:
   c. a second-type protein interaction domain; and
   d. an intracellular signaling domain;
   wherein the first-type protein interaction domain and the second-type protein interaction domain bind specifically to each other.
28. A composition comprising:
   a first polypeptide comprising:
   a. an anti-CD127 recognition domain;
   b. a first-type protein interaction domain;
   a second polypeptide comprising:
   c. an anti-CD45RO recognition domain;
   d. a fifth-type protein interaction domain; and
   a third polypeptide comprising:
   e. a second-type and a fourth-type protein interaction domain; and
   f. an intracellular signaling domain;
   wherein the first-type protein interaction domain and the second-type protein interaction domain bind specifically to each other; and
   wherein the fourth-type protein interaction domain and the fifth-type protein interaction domain bind specifically to each other.
29. A cell comprising the CAR or composition of any of paragraphs 26-28.
30. A method of treating an autoimmune disease or treating or preventing transplant rejection or GVHD in a subject in need thereof, the method comprising administering to the subject a composition and/or cell of any of the preceding paragraphs.
31. The method of paragraph 30, wherein the TCR recognition domain comprises a MHC allogenic to the subject.
32. The method of paragraph 30, wherein the TCR recognition domain comprises a MHC autologous to the transplant cells.
33. The method of paragraph 30, wherein the TCR recognition domain comprises a peptide allogenic to the subject.
34. The method of paragraph 30, wherein the TCR recognition domain comprises a peptide autologous to the transplant cells.
35. The method of any of paragraphs 32 or 34, wherein the transplant is vascularized composite allotransplantation (VCA).
36. The method of any of paragraphs 35, wherein the autoimmune disease is type 1 diabetes, multiple sclerosis, rheumatoid arthritis, or scleroderma.

Some embodiments of the technology described herein can be defined according to any of the following numbered paragraphs:
1. A composition, comprising:
   a. a TCR recognition domain; and
   one or both of:
   b. an intracellular signaling domain; and
   c. a first-type biomolecular interaction domain.
2. A composition comprising:
   a. a first polypeptide comprising at least a portion of a TCR recognition domain and a first-type biomolecular interaction domain; and
   b. a signaling polypeptide comprising a second-type biomolecular interaction domain and an intracellular signaling domain;
   wherein the first-type and second-type biomolecular interaction domains bind specifically to each other.
3. A composition comprising:
   a. a first polypeptide comprising at least a portion of a TCR recognition domain and a first-type biomolecular interaction domain; and
   b. a recognition polypeptide comprising a second recognition domain and a third-type biomolecular interaction domain;
   wherein the first-type and third-type biomolecular interaction domains bind specifically to each other.
4. A composition comprising:
   a. a first polypeptide comprising at least a portion of a TCR recognition domain and a first-type biomolecular interaction domain; and
   b. a signaling polypeptide comprising a second-type biomolecular interaction domain and an intracellular signaling domain; and
   c. a recognition polypeptide comprising a second recognition domain and a third-type biomolecular interaction domain;
   wherein the second-type and third-type biomolecular interaction domains compete for binding to the first-type biomolecular interaction domain.
5. The composition of any of paragraphs 3-4, wherein the third-type biomolecular interaction domain and first-type biomolecular interaction domain have a higher affinity for each other than the second-type biomolecular interaction domain and first-type biomolecular interaction domain.

6. A composition comprising:
   a. a first polypeptide comprising at least a portion of a TCR recognition domain and a first-type biomolecular interaction domain;
   b. a signaling polypeptide comprising a second-type biomolecular interaction domain, a fourth-type biomolecular interaction domain, and an intracellular signaling domain; and
   c. a recognition polypeptide comprising a second recognition domain and a fifth-type biomolecular interaction domain;
   wherein the first-type biomolecular interaction domain and the second-type biomolecular interaction domain bind specifically to each other; and
   wherein the fourth-type biomolecular interaction domain and the fifth-type biomolecular interaction domain bind specifically to each other.

7. The composition of paragraph 6, wherein the fourth-type biomolecular interaction domain and fifth-type biomolecular interaction domain have a weaker affinity than the second-type biomolecular interaction domain and first-type protein interaction domain.

8. The composition of any of paragraphs 6-7, wherein the first polypeptide further comprises a sixth-type biomolecular interaction domain and the recognition polypeptide further comprises a seventh-type biomolecular interaction domain which bind specifically to each other.

9. The composition of any of paragraphs 2-8, wherein the first polypeptide comprises the entire TCR recognition domain.

10. The composition of any of paragraphs 2-8, wherein the TCR recognition domain comprises at least two separate polypeptide sequences, the first polypeptide comprises at least one of the separate polypeptide sequences of the TCR recognition domain, and the first polypeptide is bound to or complexed with a second or further polypeptide sequences of the TCR recognition domain to form a TCR recognition domain.

11. The composition of any of paragraphs 1-10, wherein the TCR recognition domain comprises a non-polypeptide component.

12. The composition of any of paragraphs 3-11, wherein the second recognition domain is specific for a target that is not recognized by the TCR recognition domain.

13. The composition of any of paragraphs 3-12, wherein the second recognition domain is specific for a target that is found on a healthy and/or non-target cell and not on a diseased and/or target cell.

14. The composition of any of the preceding paragraphs, wherein the TCR recognition domain comprises a MHC (Major Histocompatibility Complex); a MHC-peptide complex; featureless peptide MHC; or a MHC-peptide fusion.

15. The composition of paragraph 14, wherein the peptide is a human or non-human peptide.

16. The composition of any of paragraphs 14-15, wherein the peptide is a Minor Histocompatibility Antigen (MiHA).

17. The composition of any of paragraphs 14-16, wherein the MHC is a monomer, dimer, trimer, tetramer, pentamer, dextramer or other oligomer form.

18. The composition of any of paragraphs 14-17, wherein the MHC-peptide complex is a monomer, dimer, trimer, tetramer, pentamer, dextramer or other oligomer form.

19. The composition of any of paragraphs 14-17, wherein the MHC-peptide fusion is a monomer, dimer, trimer, tetramer, pentamer, dextramer or other oligomer form.

20. The composition of any of paragraphs 14-17, wherein the MHC is a dimer, trimer, tetramer, pentamer, dextramer or other oligomer form.

21. The composition of any of paragraphs 14-17, wherein the MHC-peptide complex is a dimer, trimer, tetramer, pentamer, dextramer or other oligomer form.

22. The composition of any of paragraphs 14-17, wherein the MHC-peptide fusion is a dimer, trimer, tetramer, pentamer, dextramer or other oligomer form.

23. The composition of any of paragraphs 14-22, wherein the MHC is a MHC class I or a MHC class II.

24. The composition of any of paragraphs 1-13, wherein the TCR recognition domain comprises a CD1 domain or a CD1 domain-ligand complex or fusion.

25. The composition of paragraph 24, wherein the CD1 is CD1d.

26. The composition of any of the preceding paragraphs, wherein the biomolecular interaction domains are found on an extracellular portion of the respective polypeptides.

27. The composition of any of the preceding paragraphs,
   a. wherein the biomolecular interaction domain(s) is a leucine zipper, or any binding pair of biomolecular interaction domains are collectively a pair of leucine zippers;
   b. wherein the biomolecular interaction domain(s) is a BZip (RR) and/or a AZip (EE), or any binding pair of biomolecular interaction domains are collectively a BZip (RR) and a AZip (EE);
   c. wherein the biomolecular interaction domain(s) is a PSD95-Dlg1-zo-1 (PDZ) domain;
   d. wherein the biomolecular interaction domain(s) is a streptavidin and/or a streptavidin binding biomolecular (SBP) or any binding pair of biomolecular interaction domains are collectively a streptavidin and a streptavidin binding biomolecular (SBP);
   e. wherein the biomolecular interaction domain(s) is a FKBP-binding domain of mTOR (FRB) and/or a FK506 binding biomolecular (FKBP) or any binding pair of biomolecular interaction domains are collectively a FKBP-binding domain of mTOR (FRB) and a FK506 binding biomolecular (FKBP);
   f. wherein the biomolecular interaction domain(s) is a cyclophilin-Fas fusion biomolecular (CyP-Fas) and/or a FK506 binding biomolecular (FKBP) or any binding pair of biomolecular interaction domains are collectively a cyclophilin-Fas fusion biomolecular (CyP-Fas) and a FK506 binding biomolecular (FKBP);
   g. wherein the biomolecular interaction domain(s) is a calcineurin A (CNA) and/or a FK506 binding biomolecular (FKBP) or any binding pair of biomolecular interaction domains are collectively a calcineurin A (CNA) and a FK506 binding biomolecular (FKBP);
   h. wherein the biomolecular interaction domain(s) is a gibberellin insensitive (GIA) and/or a gibberellin insensitive dwarf1 (GID1) or any binding pair of biomolecular interaction domains are collectively a gibberellin insensitive (GIA) and a gibberellin insensitive dwarf1 (GID1);

i. wherein the biomolecular interaction domain(s) is a Snap-tag and/or a Halo tag, or any binding pair of biomolecular interaction domains are collectively a Snap-tag and a Halo tag;
j. wherein the biomolecular interaction domain(s) is a T14-3-3-cdeltaC and/or a C-Terminal peptides of PMA2 (CT52), or any binding pair of biomolecular interaction domains are collectively a T14-3-3-cdeltaC and a C-Terminal peptides of PMA2 (CT52);
k. wherein the biomolecular interaction domain(s) is a PYL and/or a ABI, or any binding pair of biomolecular interaction domains are collectively a PYL and a ABI;
l. wherein the biomolecular interaction domain(s) is a nucleotide tag and/or a zinc finger domain, or any binding pair of biomolecular interaction domains are collectively a nucleotide tag and a zinc finger domain;
m. wherein the biomolecular interaction domain(s) is a nucleotide tag, or any binding pair of biomolecular interaction domains are collectively a pair of nucleotide tags;
n. wherein the biomolecular interaction domain(s) is a Fluorescein isothiocyanate (FITC) and/or a FITC binding biomolecular or any binding pair of protein interaction domains are collectively a FITC and a FITC binding protein; and/or
o. wherein the protein interaction domain(s) is a (R)-Phycoerythrin (R-PE/PE) and/or a R-PE/PE binding protein or any binding pair of protein interaction domains are collectively a (R)-Phycoerythrin (R-PE/PE) and a R-PE/PE binding protein.

28. The composition of paragraph 27, wherein the nucleotide tag is a DNA tag or dsDNA tag.
29. The composition of any of the preceding paragraphs, wherein the intracellular signaling domain comprises or is a signaling domain from one or more proteins selected from the group consisting of:
    TCR FcRγ, FcRβ, CD3γ; CD3δ; CD3λ; CD3C; CD22; CD79a; CD79b; CD66d; CARD11; CD2; CD7; CD27; CD28; CD30; CD40; CD54 (ICAM); CD83; CD134 (OX40); CD137 (4-1BB); CD150 (SLAMF1); CD152 (CTLA4); CD223 (LAG3); CD270 (HVEM); CD273 (PD-L2); CD274 (PD-L1); CD278 (ICOS); DAP10; LAT; KD2C SLP76; TRIM; and ZAP70.
30. A cell comprising and/or expressing the composition of any of the preceding paragraphs.
31. A composition comprising a first polypeptide of any of the preceding paragraphs and a cell expressing or comprising the signaling polypeptide of any of the preceding paragraphs.
32. The cell or composition of any of paragraphs 30-31, wherein the TCR recognition domain comprises a MHC allogeneic, autologous, or xenogeneic to the cell.
33. The cell or composition of any of paragraphs 30-32, wherein the TCR recognition domain comprises a synthetic MHC.
34. The cell or composition of any of paragraphs 30-33, wherein the TCR recognition domain comprises a MHC and a peptide, wherein the peptide is allogeneic, autologous, or xenogeneic to the cell.
35. The cell or composition of any of paragraphs 30-34, wherein the TCR recognition domain comprises a MHC and a peptide, wherein the peptide is synthetic.
36. The cell or composition of any of paragraphs 30-35, wherein the cell is a NK cell, dendritic cell, regulatory T cell, or effector T cell.
37. The cell or composition of any of paragraphs 30-36, wherein the cell is engineered to express one of more of the polypeptide(s) of the composition.
38. The cell or composition of any of paragraphs 30-37, wherein the cell is engineered to express the signaling polypeptide of the composition.
39. The cell or composition of any of paragraphs 30-38, wherein the cell is further engineered to knockout or knockdown the native MHCI/II.
40. The cell or composition of any of paragraphs 30-39, wherein the cell is further engineered to knockdown the native MHCI/II expressed on the cell surface.
41. A chimeric antigen receptor (CAR) comprising:
    a. an anti-CD127 and/or anti-CD45RO recognition domain;
    b. an intracellular signaling domain.
42. A composition comprising:
    a first polypeptide comprising:
    a. an anti-CD127 and/or anti-CD45RO recognition domain;
    b. a first-type protein interaction domain; and
    a second polypeptide comprising:
    c. a second-type protein interaction domain; and
    d. an intracellular signaling domain;
    wherein the first-type protein interaction domain and the second-type protein interaction domain bind specifically to each other.
43. A composition comprising:
    a first polypeptide comprising:
    a. an anti-CD127 recognition domain;
    b. a first-type protein interaction domain;
    a second polypeptide comprising:
    c. an anti-CD45RO recognition domain;
    d. a fifth-type protein interaction domain; and
    a third polypeptide comprising:
    e. a second-type and a fourth-type protein interaction domain; and
    f. an intracellular signaling domain;
    wherein the first-type protein interaction domain and the second-type protein interaction domain bind specifically to each other; and
    wherein the fourth-type protein interaction domain and the fifth-type protein interaction domain bind specifically to each other.
44. A cell comprising the CAR or composition of any of paragraphs 41-43.
45. A method of treating or preventing an autoimmune disease or condition; T cell mediated inflammation or immune response; malignant T cell condition; transplant rejection; or GvHD in a subject in need thereof, the method comprising administering to the subject a composition and/or cell of any of the preceding paragraphs.
46. The method of paragraph 45, wherein the TCR recognition domain comprises a MHC allogeneic to the subject.
47. The method of paragraph 45, wherein the TCR recognition domain comprises a MHC autologous to the transplant cells.
48. The method of paragraph 45, wherein the TCR recognition domain comprises a MHC xenogeneic to the transplant cells.

49. The method of paragraph 45, wherein the TCR recognition domain comprises a MHC and a peptide, wherein the peptide is allogeneic to the subject.
50. The method of paragraph 45, wherein the TCR recognition domain comprises a MHC and a peptide, wherein the peptide is autologous to the transplant cells.
51. The method of paragraph 45, wherein the TCR recognition domain comprises a MHC and a peptide, wherein the peptide is autologous to the transplant cells.
52. The method of any of paragraphs 45-51, wherein the MHC and/or the peptide is synthetic.
53. The method of any of paragraphs 45-52, wherein the transplant is any human or non-human cell, tissue, or organ.
54. The method of any of paragraphs 45-53, wherein the transplant is an allogeneic hematopoietic stem cell or solid organ transplantation.
55. The method of any of paragraphs 45-52, wherein the malignant T cell condition is T cell acute lymphoblastic leukemia or T cell lymphoblastic lymphoma.
56. The method of any of paragraphs 45-52, wherein the autoimmune disease is type 1 diabetes, vitiligo, multiple sclerosis, alopecia, celiac disease, pemphigus, rheumatoid arthritis, or scleroderma.
57. The method of any of paragraphs 45-52, wherein the autoimmune disease is thyroiditis, type 1 diabetes mellitus, Hashimoto's thyroiditis, Graves' disease, celiac disease, multiple sclerosis, Guillain-Barre syndrome, Addison's disease, and Raynaud's phenomenon, Goodpasture's disease, arthritis (rheumatoid arthritis such as acute arthritis, chronic rheumatoid arthritis, gout or gouty arthritis, acute gouty arthritis, acute immunological arthritis, chronic inflammatory arthritis, degenerative arthritis, type II collagen-induced arthritis, infectious arthritis, Lyme arthritis (e.g., post treatment Lyme disease syndrome), proliferative arthritis, psoriatic arthritis, Still's disease, vertebral arthritis, and juvenile-onset rheumatoid arthritis, arthritis chronica progrediente, arthritis deformans, polyarthritis chronica primaria, reactive arthritis, and ankylosing spondylitis), palindromic arthritis, inflammatory hyperproliferative skin diseases, psoriasis such as plaque psoriasis, guttate psoriasis, pustular psoriasis, and psoriasis of the nails, atopy including atopic diseases such as hay fever and Job's syndrome, dermatitis including contact dermatitis, chronic contact dermatitis, exfoliative dermatitis, allergic dermatitis, allergic contact dermatitis, dermatitis herpetiformis, nummular dermatitis, seborrheic dermatitis, non-specific dermatitis, primary irritant contact dermatitis, and atopic dermatitis, x-linked hyper IgM syndrome, allergic intraocular inflammatory diseases, urticaria such as chronic allergic urticaria and chronic idiopathic urticaria, including chronic autoimmune urticaria, myositis, polymyositis/dermatomyositis, juvenile dermatomyositis, toxic epidermal necrolysis, scleroderma (including systemic scleroderma), sclerosis such as systemic sclerosis, multiple sclerosis (MS) such as spino-optical MS, primary progressive MS (PPMS), and relapsing remitting MS (RRMS), progressive systemic sclerosis, atherosclerosis, arteriosclerosis, sclerosis disseminata, ataxic sclerosis, neuromyelitis optica (NMO), inflammatory bowel disease (IBD) (for example, Crohn's disease, autoimmune-mediated gastrointestinal diseases, colitis such as ulcerative colitis, colitis ulcerosa, microscopic colitis, collagenous colitis, colitis polyposa, necrotizing enterocolitis, and transmural colitis, and autoimmune inflammatory bowel disease), bowel inflammation, pyoderma gangrenosum, erythema nodosum, primary sclerosing cholangitis, respiratory distress syndrome, including adult or acute respiratory distress syndrome (ARDS), meningitis, inflammation of all or part of the uvea, iritis, choroiditis, an autoimmune hematological disorder, rheumatoid spondylitis, rheumatoid synovitis, hereditary angioedema, cranial nerve damage as in meningitis, herpes gestationis, pemphigoid gestationis, pruritis scroti, autoimmune premature ovarian failure, sudden hearing loss due to an autoimmune condition, IgE-mediated diseases such as anaphylaxis and allergic and atopic rhinitis, encephalitis such as Rasmussen's encephalitis and limbic and/or brainstem encephalitis, uveitis, such as anterior uveitis, acute anterior uveitis, granulomatous uveitis, nongranulomatous uveitis, phacoantigenic uveitis, posterior uveitis, or autoimmune uveitis, glomerulonephritis (GN) with and without nephrotic syndrome such as chronic or acute glomerulonephritis such as primary GN, immune-mediated GN, membranous GN (membranous nephropathy), idiopathic membranous GN or idiopathic membranous nephropathy, membrano- or membranous proliferative GN (MPGN), including Type I and Type II, and rapidly progressive GN, proliferative nephritis, autoimmune polyglandular endocrine failure, balanitis including balanitis circumscripta plasmacellularis, balanoposthitis, erythema annulare centrifugum, erythema dyschromicum perstans, eythema multiform, granuloma annulare, lichen nitidus, lichen sclerosus et atrophicus, lichen simplex chronicus, lichen spinulosus, lichen planus, lamellar ichthyosis, epidermolytic hyperkeratosis, premalignant keratosis, pyoderma gangrenosum, allergic conditions and responses, allergic reaction, eczema including allergic or atopic eczema, asteatotic eczema, dyshidrotic eczema, and vesicular palmoplantar eczema, asthma such as asthma bronchiale, bronchial asthma, and auto-immune asthma, conditions involving infiltration of T cells and chronic inflammatory responses, immune reactions against foreign antigens such as fetal A-B-O blood groups during pregnancy, chronic pulmonary inflammatory disease, autoimmune myocarditis, leukocyte adhesion deficiency, lupus, including lupus nephritis, lupus cerebritis, pediatric lupus, non-renal lupus, extra-renal lupus, discoid lupus and discoid lupus erythematosus, alopecia lupus, systemic lupus erythematosus (SLE) such as cutaneous SLE or subacute cutaneous SLE, neonatal lupus syndrome (NLE), and lupus erythematosus disseminatus, juvenile onset (Type I) diabetes mellitus, including pediatric insulin-dependent diabetes mellitus (IDDM), adult onset diabetes mellitus (Type II diabetes), autoimmune diabetes, idiopathic diabetes insipidus, diabetic retinopathy, diabetic nephropathy, diabetic large-artery disorder, immune responses associated with acute and delayed hypersensitivity mediated by cytokines and T-lymphocytes, sarcoidosis, granulomatosis including lymphomatoid granulomatosis, Wegener's granulomatosis, agranulocytosis, vasculitides, including vasculitis, large-vessel vasculitis (including polymyalgia rheumatica and giant-cell (Takayasu's) arteritis), medium-vessel vasculitis (including Kawasaki's disease and polyarteritis nodosa/periarteritis nodosa), microscopic polyarteritis, immunovasculitis, CNS vasculitis, cutaneous vasculitis, hypersensitivity vasculitis, necrotizing vasculitis such as systemic necrotizing vasculitis, and ANCA-associated vasculitis, such as Churg-Strauss vasculitis or syndrome (CSS) and ANCA-associated small-vessel vasculitis, temporal arteritis, autoimmune aplastic anemia, Coombs positive anemia, Diamond Blackfan anemia, hemolytic anemia or immune hemolytic anemia including autoimmune hemolytic anemia (AIHA), pernicious anemia (anemia perniciosa), Addison's disease, pure red cell anemia or aplasia (PRCA), Factor VIII deficiency, hemophilia A, autoimmune neutropenia, pancytopenia, leukopenia, diseases involving leukocyte diapedesis, CNS inflammatory disorders, multiple organ injury syndrome such as those secondary to septicemia, trauma or hemorrhage, antigen-antibody complex-mediated diseases, anti-glomerular basement membrane disease, anti-phospholipid antibody syndrome, allergic neuritis, Behcet's disease/syndrome, Castleman's syndrome, Goodpasture's syndrome, Reynaud's syndrome, Sjogren's syndrome, Stevens-Johnson syndrome, pemphigoid such as pemphigoid bullous and skin pemphigoid, pemphigus (including pemphigus vulgaris, pemphigus foliaceus, pemphigus mucus-membrane pemphigoid, and pemphigus erythematosus), autoimmune polyendocrinopathies, Reiter's disease or syndrome, an immune complex disorder such as immune complex nephritis, antibody-mediated nephritis, polyneuropathies, chronic neuropathy such as IgM polyneuropathies or IgM-mediated neuropathy, and autoimmune or immune-mediated thrombocytopenia such as idiopathic thrombocytopenic purpura (ITP) including chronic or acute ITP, scleritis such as idiopathic cerato-scleritis, episcleritis, autoimmune disease of the testis and ovary including autoimmune orchitis and oophoritis, primary hypothyroidism, hypoparathyroidism, autoimmune endocrine diseases including thyroiditis such as autoimmune thyroiditis, Hashimoto's disease, chronic thyroiditis (Hashimoto's thyroiditis), or subacute thyroiditis, idiopathic hypothyroidism, Grave's disease, polyglandular syndromes such as autoimmune polyglandular syndromes (or polyglandular endocrinopathy syndromes), paraneoplastic syndromes, including neurologic paraneoplastic syndromes such as Lambert-Eaton myasthenic syndrome or Eaton-Lambert syndrome, stiff-man or stiff-person syndrome, encephalomyelitis such as allergic encephalomyelitis or encephalomyelitis allergica and experimental allergic encephalomyelitis (EAE), myasthenia gravis such as thymoma-associated myasthenia gravis, cerebellar degeneration, neuromyotonia, opsoclonus or opsoclonus myoclonus syndrome (OMS), and sensory neuropathy, multifocal motor neuropathy, Sheehan's syndrome, autoimmune hepatitis, lupoid hepatitis, giant-cell hepatitis, autoimmune chronic active hepatitis, lymphoid interstitial pneumonitis (LIP), bronchiolitis obliterans (non-transplant) vs NSIP, Guillain-Barre syndrome, Berger's disease (IgA nephropathy), idiopathic IgA nephropathy, linear IgA dermatosis, acute febrile neutrophilic dermatosis, subcorneal pustular dermatosis, transient acantholytic dermatosis, cirrhosis such as primary biliary cirrhosis and pneumonocirrhosis, autoimmune enteropathy syndrome, Celiac or Coeliac disease, celiac sprue (gluten enteropathy), refractory sprue, idiopathic sprue, cryoglobulinemia, amylotrophic lateral sclerosis (ALS; Lou Gehrig's disease), coronary artery disease, autoimmune ear disease such as autoimmune inner ear disease (AIED), autoimmune hearing loss, polychondritis such as refractory or relapsed or relapsing polychondritis, pulmonary alveolar proteinosis, Cogan's syndrome/nonsyphilitic interstitial keratitis, Bell's palsy, Sweet's disease/syndrome, rosacea autoimmune, zoster-associated pain, amyloidosis, a non-cancerous lymphocytosis, a primary lymphocytosis, which includes monoclonal B cell lymphocytosis (e.g., benign monoclonal gammopathy and monoclonal gammopathy of undetermined significance, MGUS), peripheral neuropathy, paraneoplastic syndrome, channelopathies including channelopathies of the CNS, autism, inflammatory myopathy, focal or segmental or focal segmental glomerulosclerosis (FSGS), endocrine opthalmopathy, uveoretinitis, chorioretinitis, autoimmune hepatological disorder, fibromyalgia, multiple endocrine failure, Schmidt's syndrome, adrenalitis, gastric atrophy, presenile dementia, demyelinating diseases such as autoimmune demyelinating diseases and chronic inflammatory demyelinating polyneuropathy, Dressler's syndrome, alopecia areata, alopecia totalis, CREST syndrome (calcinosis, Raynaud's phenomenon, esophageal dysmotility, sclerodactyly, and telangiectasia), male and female autoimmune infertility, e.g., due to anti-spermatozoan antibodies, mixed connective tissue disease, Chagas' disease, rheumatic fever, recurrent abortion, farmer's lung, erythema multiforme, post-cardiotomy syndrome, Cushing's syndrome, bird-fancier's lung, allergic granulomatous angiitis, benign lymphocytic angiitis, Alport's syndrome, alveolitis such as allergic alveolitis and fibrosing alveolitis, interstitial lung disease, transfusion reaction, Sampter's syndrome, Caplan's syndrome, endocarditis, endomyocardial fibrosis, diffuse interstitial pulmonary fibrosis, interstitial lung fibrosis, pulmonary fibrosis, idiopathic pulmonary fibrosis, cystic fibrosis, endophthalmitis, erythema elevatum et diutinum, erythroblastosis fetalis, eosinophilic faciitis, Shulman's syndrome, Felty's syndrome, cyclitis such as chronic cyclitis, heterochronic cyclitis, iridocyclitis (acute or chronic), or Fuch's cyclitis, Henoch-Schonlein purpura, SCID, sepsis, endotoxemia, post-vaccination syndromes, Evan's syndrome, autoimmune gonadal failure, Sydenham's chorea, post-streptococcal nephritis, thromboangitis ubiterans, thyrotoxicosis, tabes dorsalis, chorioiditis, giant-cell polymyalgia, chronic hypersensitivity pneumonitis, keratoconjunctivitis sicca, idiopathic nephritic syndrome, minimal change nephropathy, benign familial and ischemia-reperfusion injury, transplant organ reperfusion, retinal autoimmunity, aphthae, aphthous stomatitis, arteriosclerotic disorders, aspermiogenesis, autoimmune hemolysis, Boeck's disease, enteritis allergica, erythema nodosum leprosum, idiopathic facial paralysis, chronic fatigue syndrome, febris rheumatica, Hamman-Rich's disease, sensoneural hearing loss, ileitis regionalis, leucopenia, transverse myelitis, primary idiopathic myxedema, ophthalmia symphatica, polyradiculitis acuta, pyoderma gangrenosum, acquired spenic atrophy, vitiligo, toxic-shock syndrome, conditions involving infiltration of T cells, leukocyte-adhesion deficiency, immune responses associated with acute and delayed hypersensitivity mediated by cytokines and T-lymphocytes, diseases involving leukocyte diapedesis, multiple organ injury syndrome, antigen-antibody complex-mediated diseases, antiglomerular basement membrane disease, allergic neuritis, autoimmune polyendocrinopathies, oophoritis, primary myxedema, autoimmune atrophic gastritis, rheumatic diseases, mixed connective tissue disease, nephrotic syndrome, insulitis, polyendocrine failure, autoimmune polyglandular syndrome type I, adult-onset idiopathic hypoparathyroidism (AOIH), myocarditis, nephrotic syndrome, primary sclerosing cholangitis, acute or chronic sinusitis, ethmoid, frontal, maxillary, or sphenoid sinusitis, an eosinophil-related disorder such as eosinophilia, pulmonary infiltration eosinophilia, eosinophilia-myalgia syndrome, Loffler's syndrome, chronic eosinophilic pneumonia, tropical pulmonary eosinophilia, granulomas containing eosinophils, seronegative spondyloarthritides, polyendocrine autoimmune disease, sclerosing cholangitis, sclera, episclera, Bruton's syndrome, transient hypogammaglobulinemia of infancy, Wiskott-Aldrich syndrome, ataxia telangiectasia syndrome, angiectasis, autoimmune disorders associated with collagen disease, rheumatism, allergic hypersensitivity disorders, glomerulonephritides, reperfusion injury, ischemic reperfusion disorder, lymphomatous tracheobronchitis, inflammatory dermatoses, dermatoses with acute inflammatory components, and autoimmune uveoretinitis (AUR).

58. The method of any of paragraphs 45-52, wherein the T cell mediated immune response is an anti-drug specific response to a biologic, cell therapy, and/or gene therapy.

59. The method of paragraph 58, wherein the biologic, cell-therapy, or gene therapy is an adeno-associated virus (AAV) gene therapy, a genome editing agent, or enzyme replacement therapy.

60. The method of any of paragraphs 45-52, wherein the disease is type 1 diabetes and the TCR recognition domain comprises sequences with at least 80% or at least 95% sequence identity to: one or more of SEQ ID NOs: 8-17; HLA-A*0201 and at least one of SEQ ID NOs: 2013-2016 and 2031-2033; or HLA-A*02:01 and at least one of SEQ ID NOs: 20128-2129.

61. The method of any of paragraphs 45-52, wherein the disease is vitiligo and the TCR recognition domain comprises sequences with at least 80% or at least 95% sequence identity to: SEQ ID NO: 18, 19, and one of 20-22; or comprises HLA-A*0201 and SEQ ID NO: 2018; or HLA-A*0301 and SEQ ID NO: 2019; or comprises HLA-A*2402 and SEQ ID NO: 2020; or HLA-A*0101 and SEQ ID NO: 2021.

62. The method of any of paragraphs 45-52, wherein the method is a method of treating and/or preventing GvHD and the TCR recognition domain comprises sequences with at least 80% or at least 95% sequence identity to: HLA-A*0101 and at least one of SEQ ID NOs: 2034-2037; or HLA-B*0702 and SEQ ID NO: 2038; or HLA-B*0801 and SEQ ID NO: 2039.

63. The method of any of paragraphs 45-52, wherein the disease is type 1 diabetes and the TCR recognition domain comprises one or more of SEQ ID NOs: 8-17; comprises HLA-A*0201 and at least one of SEQ ID NOs: 2013-2016 and 2031-2033; or comprises HLA-A*02:01 and at least one of SEQ ID NOs: 20128-2129.

64. The method of any of paragraphs 45-52, wherein the disease is vitiligo and the TCR recognition domain comprises SEQ ID NO: 18, 19, and one of 20-22; or comprises HLA-A*0201 and SEQ ID NO: 2018; or comprises HLA-A*0301 and SEQ ID NO: 2019; or comprises HLA-A*2402 and SEQ ID NO: 2020; or comprises HLA-A*0101 and SEQ ID NO: 2021.

65. The method of any of paragraphs 45-52, wherein the method is a method of treating and/or preventing GvHD and the TCR recognition domain comprises HLA-A*0101 and at least one of SEQ ID NOs: 2034-2037; or comprises HLA-B*0702 and SEQ ID NO: 2038; or comprises HLA-B*0801 and SEQ ID NO: 2039.

Some embodiments of the technology described herein can be defined according to any of the following numbered paragraphs:

1. A composition, comprising:
   a. a TCR recognition domain; and
   one or both of:
   b. an intracellular signaling domain; and
   c. a biomolecular interaction domain.
2. The composition of paragraph 1, comprising a TCR recognition domain and a biomolecular interaction domain.
3. The composition of paragraph 1, comprising a TCR recognition domain and an intracellular signaling domain.
4. The composition of paragraph 1, wherein the biomolecular interaction domain of c) is a first-type biomolecular interaction domain and the composition further comprises a signaling polypeptide comprising a second-type biomolecular interaction domain and an intracellular signaling domain; wherein the first-type and second-type biomolecular interaction domains bind specifically to each other.
5. The composition of paragraph 1, wherein the TCR recognition domain comprises a MHC (Major Histocompatibility Complex); a MHC-peptide complex; a featureless peptide MHC; or a MHC-peptide fusion.
6. The composition of paragraph 1, wherein the TCR recognition domain comprises a CD1 domain or a CD1 domain-ligand complex or fusion.
7. The composition of paragraph 6, wherein the CD1 is CD1d.
8. The composition of paragraph 1, wherein the TCR recognition domain is a monomer, dimer, trimer, tetramer, pentamer, dextramer or other oligomer form.
9. The composition of paragraph 1,
   a. wherein the biomolecular interaction domain(s) is a leucine zipper, or any binding pair of biomolecular interaction domains are collectively a pair of leucine zippers;
   b. wherein the biomolecular interaction domain(s) is a BZip (RR) and/or a AZip (EE), or any binding pair of biomolecular interaction domains are collectively a BZip (RR) and a AZip (EE);
   c. wherein the biomolecular interaction domain(s) is a PSD95-Dlg1-zo-1 (PDZ) domain;
   d. wherein the biomolecular interaction domain(s) is a streptavidin and/or a streptavidin binding biomolecular (SBP) or any binding pair of biomolecular interaction domains are collectively a streptavidin and a streptavidin binding biomolecular (SBP);
   e. wherein the biomolecular interaction domain(s) is a FKBP-binding domain of mTOR (FRB) and/or a FK506 binding biomolecular (FKBP) or any binding pair of biomolecular interaction domains are collectively a FKBP-binding domain of mTOR (FRB) and a FK506 binding biomolecular (FKBP);
   f. wherein the biomolecular interaction domain(s) is a cyclophilin-Fas fusion biomolecular (CyP-Fas) and/ or a FK506 binding biomolecular (FKBP) or any binding pair of biomolecular interaction domains are collectively a cyclophilin-Fas fusion biomolecular (CyP-Fas) and a FK506 binding biomolecular (FKBP);

g. wherein the biomolecular interaction domain(s) is a calcineurin A (CNA) and/or a FK506 binding biomolecular (FKBP) or any binding pair of biomolecular interaction domains are collectively a calcineurin A (CNA) and a FK506 binding biomolecular (FKBP);

h. wherein the biomolecular interaction domain(s) is a gibberellin insensitive (GIA) and/or a gibberellin insensitive dwarf1 (GID1) or any binding pair of biomolecular interaction domains are collectively a gibberellin insensitive (GIA) and a gibberellin insensitive dwarf1 (GID1);

i. wherein the biomolecular interaction domain(s) is a Snap-tag and/or a Halo tag, or any binding pair of biomolecular interaction domains are collectively a Snap-tag and a Halo tag;

j. wherein the biomolecular interaction domain(s) is a T14-3-3-cdeltaC and/or a C-Terminal peptides of PMA2 (CT52), or any binding pair of biomolecular interaction domains are collectively a T14-3-3-cdeltaC and a C-Terminal peptides of PMA2 (CT52);

k. wherein the biomolecular interaction domain(s) is a PYL and/or a ABI, or any binding pair of biomolecular interaction domains are collectively a PYL and a ABI;

l. wherein the biomolecular interaction domain(s) is a nucleotide tag and/or a zinc finger domain, or any binding pair of biomolecular interaction domains are collectively a nucleotide tag and a zinc finger domain;

m. wherein the biomolecular interaction domain(s) is a nucleotide tag, or any binding pair of biomolecular interaction domains are collectively a pair of nucleotide tags;

n. wherein the biomolecular interaction domain(s) is a Fluorescein isothiocyanate (FITC) and/or a FITC binding biomolecular or any binding pair of protein interaction domains are collectively a FITC and a FITC binding protein; and/or o. wherein the protein interaction domain(s) is a (R)-Phycoerythrin (R-PE/PE) and/or a R-PE/PE binding protein or any binding pair of protein interaction domains are collectively a (R)-Phycoerythrin (R-PE/PE) and a R-PE/PE binding protein.

10. The composition of paragraph 9, wherein the nucleotide tag is a DNA tag or dsDNA tag.

11. The composition of paragraph 2, further comprising a cell expressing or comprising the signaling polypeptide.

12. The composition of paragraph 11, wherein the TCR recognition domain is allogeneic, autologous, or xenogenic to the cell.

13. The composition of paragraph 11, wherein the TCR recognition domain is synthetic.

14. The composition of paragraph 11, wherein the TCR recognition domain comprises a MHC and a peptide, wherein the peptide is allogeneic, autologous, or xenogenic to the cell.

15. The composition of paragraph 11, wherein the TCR recognition domain comprises a MHC and a peptide, wherein the peptide is synthetic.

16. The composition of paragraph 11, wherein the cell is a NK cell, dendritic cell, regulatory T cell, or effector T cell.

17. The composition of paragraph 11, wherein the cell is further engineered to knockdown the native MHCI/II expressed on the cell surface.

18. A method of treating or preventing an autoimmune disease or condition; T cell mediated inflammation or immune response; malignant T cell condition; transplant rejection; or GvHD in a subject in need thereof, the method comprising administering to the subject a composition of paragraph 1.

19. The method of paragraph 18, wherein the transplant is an allogeneic hematopoietic stem cell or solid organ transplantation.

20. The method of paragraph 18, wherein the malignant T cell condition is T cell acute lymphoblastic leukemia or T cell lymphoblastic lymphoma.

21. The method of paragraph 18, wherein the autoimmune disease is type 1 diabetes, vitiligo, multiple sclerosis, alopecia, celiac disease, pemphigus, rheumatoid arthritis, or scleroderma.

22. The method of paragraph 18, wherein the T cell mediated immune response is an anti-drug specific response to a biologic, cell therapy, and/or gene therapy.

23. The method of paragraph 22, wherein the biologic, cell-therapy, or gene therapy is an adeno-associated virus (AAV) gene therapy, a genome editing agent, or enzyme replacement therapy.

24. The method of paragraph 18, wherein the disease is type 1 diabetes and the TCR recognition domain comprises sequences with at least 95% sequence identity to: one or more of SEQ ID NOs: 8-17; HLA-A*0201 and at least one of SEQ ID NOs: 2013-2016 and 2031-2033; or HLA-A*02:01 and at least one of SEQ ID NOs: 20128-2129.

25. The method of paragraph 18, wherein the disease is vitiligo and the TCR recognition domain comprises sequences with at least 95% sequence identity to: SEQ ID NO: 18, 19, and one of 20-22; or HLA-A*0201 and SEQ ID NO: 2018; or HLA-A*0301 and SEQ ID NO: 2019; or comprises HLA-A*2402 and SEQ ID NO: 2020; or HLA-A*0101 and SEQ ID NO: 2021.

26. The method of paragraph 18, wherein the method is a method of treating and/or preventing GvHD and the TCR recognition domain comprises sequences with at least 95% sequence identity to: HLA-A*0101 and at least one of SEQ ID NOs: 2034-2037; or HLA-B*0702 and SEQ ID NO: 2038; or HLA-B*0801 and SEQ ID NO: 2039.

EXAMPLES

Example 1

Auto- and allo-reactive T cells attacking patient's or donor's cells or organs is the major cause of autoimmunity and transplant rejection. Current treatments involve stringent immunosuppressant therapy, which can lead to severe side effects. Specifically, depletion of auto and alloreactive T cells prevents autoimmunity and transplant rejection without immunosuppressant modalities. T cells engineered with a Chimeric antigen ligand (CAL) can redirect their specificity toward the pathologic T cells. T cells engineered with a Chimeric antigen receptor (CAR) can redirect their specificity and have already been approved to treat some types of B cell malignancies. Currently, engineered regulatory T cell, which can inhibit immune reactions in an antigen-dependent manner, is under investigation to expand the application of CAR T cells therapies such as autoimmune disease and transplant rejection.

To specifically deplete disease causing T cells, described herein is a CAL and/or CAR that can recognize and bind to the specific T cell receptor on the disease causing T cells. This CAL and/or CAR is a composed of a peptide-HLA (e.g., a monomer or multimer or oligomer thereof) as the recognition domain fused to signaling domains from T cell receptors. A split version of the system can also be generated where the system is composed of two pieces. One piece is an universal CAR with T cell signaling domains as the intracellular portion and a biomolecular interaction domain as the extracellular domain. The second piece is an adaptor molecule, e.g, a CAL composed of a peptide-HLA oligomers (or monomer or multimer) fused to the cognate biomolecular interaction domain.

Most CAR T cells therapies for autoimmune disease and transplant rejection uses regulatory T cells and are designed to target the organ to provide organ-specific, e.g., local immunosuppression. In contrast, the present, e.g., CAL, design is targeting the source immune cells inside that patient that are causing the disease. Accordingly, provided herein is a cell-based therapy for autoimmune diseases and transplant rejection.

Example 2

Dendritic cells (DCs) are the interconnection between innate and adaptive immune system and are able to induce protective immune responses following stimulation by a variety of stimuli. Based on their phenotype and function, DCs can be divided into conventional DCs and plasmacytoid DCs (pDCs). Many studies have shown that DCs are essential mediators of pro-inflammatory or anti-inflammatory (tolerogenic) responses. The subsets of DCs that suppress immune responses are generally known as tolerogenic DCs because of their functions in inducing T cell apoptosis, anergy and regulatory T cells (Tregs).

A tolerogenic state in DCs (tol-DC) can be induced using several pharmacological agents, such as cyclosporine A, rapamycin, dexamethasone, vitamin A, vitamin D or other cytokines and growth factors. Recently, the insertion of exogenous DNA to enhance tol-DC function has been investigated as a therapeutic possibility for treating autoimmune diseases. 'Killer' DCs, obtained by transfection with DNA encoding FasL or TNF-related apoptosis-inducing ligand, efficiently induce T-cell apoptosis and prevent the rejection of heart grafts in animal models.

However, the effect of these DCs are not specific. Overexpression of inhibitory molecules, including IL-10, TGF-$\beta$, CTLA-4 and SOCS1, enable tol-DCs to more efficiently induce Tregs which might cause systemic immune suppression.

Alloreactive immune cells can be suppressed in a specific manner using the methods described herein, e.g., by using a universal UniCAR DC system that presents the donors' pMHC tetra/dextramers (e.g., the CAL) and binds to a genetically engineered DC (K/O MHC I/II but presents donor peptide on the tetra/dextramer). In some embodiments, the pMHC can be provided as a monomer, oligomer, or multimer.

Any form of the recipient pMHC (e.g., monomer/oligomer/tetramer/dextramer)+ targeting module (e.g, the CAL) can be used with CAR-DC for the suppression of allo-reactive T-cells in the recipients. A library of identified different alloantigens+correlated or associated with MHC monomers/oligomers/tetramers/dextramers (e.g. HLA-A2+ insulin peptide) and attached to the targeting molecules of the CAL and/or CAR system can be produced. Such a library can be commercially available to be combined with DCs for targeting and destroying the auto reactive T-cells.

Cells can be produced that are genetically modified with the specific gene deletion of some genes (IL-12 and NF-$\kappa$B, MHC I and MHC II [The targeting module will provide these cells with the donor's MHCs]) and insertion of some other genes (IL-10, TGF-$\beta$, CTLA-4 and SOCS1). These cells can be commercially ready to use and could be combined with the specific donor, pMHC and targeting module chosen from the aforementioned library.

Example 3

Alloreactive memory T cells have been shown to have the key role in the activation of the recipient immune system and rejection of the allograft. They are known to be the main barrier for tolerance induction through mixed chimerism and other strategies. These cells are very resilient and not responsive to the preconditioning protocols and they recover from irradiation and T cell depletion rapidly. By using CAR-T-effector (Conventional, Supra, Universal CAL or CAR) and attaching any form of the donors' pMHC (monomer, oligomer, tetramer or dextramer) (e.g., a CAL) to the system, the resulting compositions of the invention can be used to decrease or eliminate the need for improved immunosuppressant therapy in the context of transplantation. The engraftment of hematopoietic stem cells can achieve durable mixed chimerism with minimal or no need for toxic preconditioning protocols.

If donor pMHC (monomer/oligomer/tetramer/dextramer; e.g., a CAL) is used in combination with CAR T effector for the abrogation of the allo/xeno reactive T-cells in the recipient, the need for immunosuppressants would be decreased or eliminated. A library of different Donor MHC monomers/oligomers/tetramers attached to the targeting molecules (e.g., the CALs) of the SUPRA/UNI/universal CAL and/or CAR system can be produced to be commercially available. A shelf ready library of the most prevalent MHC (+immunologic wildtype or synthetic peptide molecules that could be used to be combined with the MHC) monomers/oligomers/tetramers could be commercially produced and offered to be used with this system.

Example 4

The involvement of the adaptive immune system in auto-immune diseases has been extensively characterized. T cells are critical contributors to autoimmune diseases. Conventional T (Teff or T helper) cell subsets that play a role in B cell activation and differentiation produce various inflammatory cytokines and destroy target cells with direct cytotoxicity. CAR-T cells have been used to destroy autoimmune B and T cells in a fashion similar to the way in which CD19CAR T cells target and destroy leukemia cells. Targeting autoreactive memory T and B-cells has shown some results. As these methods are nonspecific, they induce some extent of generalized immune suppression and they are not completely effective. The correlation of particular peptide+ MHC molecules with certain autoimmune conditions have been expansively studied. By using the available human/animal model pMHC monomer/oligomer/tetra/dextramers and combining them with the SUPRA/UNI/universal CAL and/or CAR technology, we are able to target the autoreactive immune cells in a highly specific manner.

If any form of auto-antigen on pMHC (monomer/oligomer/tetramer/dextramer) (e.g., the CAL) is used in combination with CAR T effector/Treg to abrogate autoreactive T-cells in the recipient, the need for immunomodulatory drugs would be decreased or eliminated. A library of identified autoantigens and correlated MHC monomer/oligomer/tetra/dextramers (e.g. HLA-A2+insulin peptide) attached to the targeting molecules of the SUPRA/UNI/universal CAL and/or CAR system can be produced to be commercially available to be combined with ideal SUPRA or universal CAR T-reg/T effector for targeting and destroying the autoreactive T-cells.

Example 5

Although new advances have increased survival after allogeneic hematopoietic stem cell transplantation (HCT), chronic graft-versus-host disease (GvHD) is still the leading cause of late morbidity and mortality after transplant. Current treatment choices are limited in efficacy specifically in steroid-refractory disease, and there is no robust data to help with management decisions.

Adoptive T cell therapy (ACT) refers to the therapeutic use of T cells. T cells genetically engineered to express chimeric antigen receptors (CAR) constitute the most clinically advanced form of ACT approved to date for the treatment of CD19-positive leukemias and lymphomas and have produced remarkable results in the clinic. The technology described herein permits the opportunity to target diseased cells with specific antigens or receptors very accurately. In the context of GvHD, universal UNICAR T cells can be designed to find the recipient reactive T cell in the donor T cell populations. If the pMHC of the recipients is fused to a Target Module that binds to the UniCAR (e.g, to form a CAL), this system can recognize the TCR repertoires in the donor T/B cell population that can bind to those MHCs. If the recipients' pMHCs are fused to a target module that binds to the universal CAR, this system can recognize and bind to the T cell repertoires in the donor T cell population that can bind to those MHCs.

If the recipient pMHC (monomer/oligomer/tetramer/dextramer) (e.g., a CAL) is used in combination with CAR T effector/Treg for the abrogation of the recipient reactive T-cells in the donor HSC, these reactive T-cells will be depleted and GvHD would not happen. A library of identified different antigens+correlated human/animal models MHC tetramers/dextramers (e.g. HLA-A2+ peptide) attached to the targeting molecules of the SUPRA/UNI CAR system can be produced to be commercially being available to be combined with ideal SUPRA CAR T-reg/T effector for targeting and destroying the reactive T-cells against the recipients. A library of wild type and/or synthetic MHC monomers/oligomers (e.g. HLA-A2+ peptide) attached to the targeting molecules of the universal CAL system can be generated to be mixed with universal CAL T-reg/T effector for targeting and killing the reactive T-cells against the recipients within the donor T cell population.

Example 6

Although new advances have increased survival after allogeneic hematopoietic stem cell transplantation (HCT), chronic graft-versus-host disease (GvHD) is still the leading cause of late morbidity and mortality after transplant. Current treatment choices are limited in efficacy specifically in steroid-refractory disease, and there is no robust data to help with management decisions.

Adoptive T cell therapy (ACT) refers to the therapeutic use of T cells. T cells genetically engineered to express chimeric antigen receptors (CAR) constitute the most clinically advanced form of ACT approved to date for the treatment of CD19-positive leukemias and lymphomas and produced remarkable results in clinical. This technology provides the opportunity to target the cells with specific antigens or receptors very accurately. In the context of GvHD, UNICAR T cells can be designed to find the recipient reactive T cell in the donor T cell populations. If the pMHC of the recipients be fused to a Target Module that bind to the UniCAR, this system can recognize the TCR repertoires in the donor T/B cell population that can bind to those MHCs.

If the recipient pMHC (tetramer/dextramer) is used in combination with CAR T effector/Treg for the abrogation of the recipient reactive T-cells in the donor HSC, these cells will be depleted and GvHD would not happen. A library of identified different antigens+correlated human/animal models MHC tetramers/dextramers (e.g. HLA-A2+ peptide) attached to the targeting molecules of the SUPRA/UNI CAR system can be produced to be commercially being available to be combined with ideal SUPRA CAR T-reg/T effector for targeting and destroying the reactive T-cells against the recipients.

Example 7—Engineered Lymphocytes for Prevention of Pediatrics Vascularized Composite Allograft Rejection Engineered Described herein is the development of a clinically applicable tolerance-inducing regimen for VCA transplantation through the establishment of stable mixed chimerism, augmented by the state-of-the-art CAL and/or CAR T cell adoptive immunotherapy and synthetic biology.

Mixed chimerism in animal models and human allograft recipients have only shown to be transient, suggesting that tolerance here relies on the peripheral inactivation of donor-specific T cell. The difficulty in achieving durable mixed chimerism and long-term graft acceptance is the presence of high levels of alloreactive memory T cells that are known to hinder tolerance induction in sensitized rodents, NHPs, and human. The present approach to achieving stable mixed chimerism is to utilize advanced engineering techniques to generate CAL and/or CAR T cell therapeutics to specifically delete the recipient's alloreactive memory immune cells that are reactive against the donor bone marrow and tissue cells to help with engraftment of HSCT and stable mixed chimerism. Selective depletion of memory T lymphocytes with CAL and/or CAR-T cell therapy can help to achieve durable mixed chimerism and tolerance which eventually leads to an immunosuppressant free regimen. Currently this challenge is addressed by administering several immunosuppressant combinations in combination with intense whole-body irradiation which result in depletion of all the immune cells as a consequence of nonspecific targeting. This shotgun approach imposes a severe immune compromised state to the recipients which subsequently brings myriads of consequences including opportunistic infections and malignancies. The technology herein can delete specifically memory T cells (Aim 1) or only alloreactive memory T cells (Aim 2):

Aim 1: It has been shown that CD127+/CD45RO+ memory T cells have a significant role as central, effector and stem cell memory T cells and are known as the most potent constituents of the alloreactive T cell repertoire. These cells have been shown to be the major contributor in chronic rejection of the allograft. To address the challenge of memory T cells a CAL and/or CAR T-effector cell can be generated with scfv against two general markers of memory T cells (CD127+ and CD45RO+). This will be followed by the induction of mixed chimerism protocol in a double humanized mouse model. The results from this aim will show depletion of memory T-cells increases the efficacy of mixed chimerism protocol by improving the engraftment of hematopoietic stem cells hence helping to eliminate or decrease the need for immunosuppressant in mixed chimerism induction protocols.

Aim 2: Due to the diversity of antigen-specific T cells in the context of transplantation, a CAL and/or CAR system is provided that has the flexibility to locate and attack different alloreactive T cells simultaneously. CAL and/or CAR T-eff cells with donor pMHC can target alloreactive T-cells that have TCR against the donor MHCs. We will start with single and double specific antigen-MHC systems. Then, we will utilize a peptide library that is generated from the donor's allograft peptidome to be loaded on commercially-available, exchangeable peptide-MHC multimers. The combination of these pMHCs and CAL and/or CAR T cells will be used to target and destroy alloreactive T cells of the recipients. This development provides a flexible CAL and/or CAR design that can target antigen specific alloreactive T cells.

Described herein is the investigation of a novel adaptive immune cell therapy strategy, making use of the CAL and/or CAR T-cell technology, for VCA tolerance induction.

Example 8—Engineered Lymphocytes for Prevention of Pediatrics Vascularized Composite Allograft Rejection Significance: There are nearly 2 million people living with limb loss in the US, where over 185,000 amputations occur each year, most of which are sustained by victims of burn injuries, traffic accidents, and medical conditions[1]. 112600 children with amputations were treated in US emergency departments alone from 1990 to 2002. Children are frequently the victims of severe burns with limb loss[2] and they will suffer from its consequences for the rest of their lives. Over the last decade, vascularized composite allotransplantation (VCA), the transplantation of limbs and face from a deceased donor, has become a good alternative for the reconstruction of devastating injuries of these specialized tissues. VCA represents a unique new treatment option for severe soft tissue defects following burn injury to achieve both psychosocial and functional rehabilitation[3]. The world's first pediatric bilateral hand transplant was successfully performed between an unrelated donor-recipient pair in 2016[4]. The shortcoming is that despite the use of potent immunosuppressive drugs, acute rejection of "foreign" VCA occurs in up to 90% of patients[5]. Increased doses of immunosuppression, with numerous life-threatening complications, is the current approach to prevent loss of the VCA[5].

During the course of evolution, our immune system has gained the ability to recognize self from nonself cells and attack the "foreigners" by cells such as T Lymphocytes. The Human Leukocyte Antigen (HLA) system (Major Histocompatibility Complex [MHC] in human) comprises cell surface molecules specialized to present antigenic peptides to the T-cell[67]. These peptides are known as Minor Histocompatibility Antigens (MiHA). MiHA sequences can differ among individuals and many of these differences can be recognized by T cells, hence causing the initiation of the rejection process. T-cells are trained to recognize self from non-self MHC/peptides. Each person can present a combination of 12 different MHC class I/II on the surface of his/her cells. (HLA) typing is used to match recipients and donors MHCs for transplants. A close match between a donor's and a recipient's HLA markers is essential for a successful transplant outcome. A potential donor must match a minimum of 6-8 HLA markers which makes finding an ideal donor very difficult. Even after finding the semi ideal donor these patients will be on immunosuppressants for the rest of their life[8]. While these drugs are generally effective, the sequelae of such chronic immunosuppression are well known, and most recipients continue to develop myriad side effects and complications, including opportunistic infections, multiple organ dysfunction, and malignancies.

Transplantation tolerance that allows for the elimination of immunosuppressive drugs, has been the "holy grail" for transplantation medicine since its beginnings[9]. Developing a reproducible, safe tolerance induction protocol would expand VCA use in burn patients as well as in congenital anomalies as demonstrated by the successful transplantation of the arm and hand[6] and the lower extremity[10]. The extension into other organ transplants is also a clear direction to broaden the significance. The overall goal of this research is to enable the clinically applicable tolerance-inducing regimen for VCA transplantation through the establishment of stable mixed chimerism, augmented by the state-of-the-art adoptive immunotherapy and synthetic biology.

Tolerance can be induced through the development of a mixed chimerism protocol for VCA transplants in partially mismatched subjects[8,11]. Mixed chimerism is the use of a donor hematopoietic stem cell transplant (HSCT) along with a VCA to induce a hybrid immune system in the recipient that recognizes the donor VCA as "self" and therefore does not reject it. Mixed chimerism in nonhuman primates (NHPs) and human allograft recipients has only shown to be transient, suggesting that tolerance here relies on the peripheral inactivation of donor-specific T cell. The difficulty in achieving durable mixed chimerism and long-term graft acceptance is the presence of high levels of alloreactive memory T cells that are known to hinder tolerance induction in both sensitized rodents[12,13] and NHPs[14,15]. The present approach to achieving stable mixed chimerism is to utilize advanced engineering techniques to generate T cell therapeutics to specifically delete the recipient's alloreactive memory immune cells that are reactive against the donor bone marrow and tissue cells.

Cellular Immunotherapy

Recently, T cells that are genetically engineered to express chimeric antigen receptor (CAR) produced remarkable results for the treatment of CD19-positive leukemias and lymphomas, leading to complete remissions in pediatric patients[16,17] and evidencing that immune cells can be targeted and eliminated by CAR T cell technology. Thus far, CAR T therapeutics have led to two FDA-approved therapies—the two medication were licensed by Novartis and Gilead in the value 9 and 12 billion dollars[18]. First-generation CARS contained only an extracellular antigen-binding domain, a transmembrane domain, and the signaling domain of CD3z. In later generation CARs, intracellular costimulatory domains, derived from either CD28/4-1BB were added to enhance proliferation, persistence, and activity[19]. Recently, to expand the capability of CAR T cells, we introduced a split, universal, and "programmable" (SUPRA) CAR system that simultaneously encompasses multiple critical features[20]. This system has the ability to switch targets without reengineering the T cells, finely tune T cell activation strength, and sense and respond to multiple antigens. These features make the split CAR-T technology uniquely suitable for targeting alloreactive T-cells in recipients and enhancing transplantation tolerance.

Mixed Chimerism and Tolerance Induction in VCA

Large animal models of Mixed Chimerism: Our laboratory achieved transient mixed chimerism in two-haplotype full-mismatch MGH miniature swine after musculocutaneous VCA and nonmyeloablative recipient conditioning (total body irradiation (TBI) and transient T-cell depletion) concomitant to bone marrow transplantation (BMT)[21]. While the immunomodulatory effect of BMT was demonstrated through in vitro unresponsiveness to the donor, the chimerism levels fell rapidly following cessation of immunosuppression with resulting VCA rejection and loss. This was the first experimental VCA study to demonstrate that transient chimerism alone is neither sufficient for achieving transplant tolerance nor prolonging VCA survival.

Recently, in order to progress towards clinical translation, the previous Mixed Chimerism Induction Protocols (MCIP) in miniature swine were modified to remove T-cell depletion completely in exchange for a higher dose, TBI and TI commencing two days prior to surgery. Following osteomyocutaneous VCA, a pen-operative course of co-stimulatory blockade was given (on POD0, 2, 4 and 6) in addition to a 30-day regimen of tacrolimus (target levels: 10-15 ng/mL) before gradual taper to discontinuation on POD 45[22]. With this MCIP, we were indeed able to achieve stable mixed chimerism (n=2) following donor BMT without the development of split tolerance in MHC class I mismatched/class II matched recipients and have successfully withdrawn all immunosuppression for >100 days. Building on these results, the next iteration towards clinical translation of these studies is to decrease the toxicity of current protocol to be able to extend it for achieving stable mixed chimerism across full MHC-mismatch barriers—which can utilize immunomodulatory strategies such as CAL and/or CAR T cell therapy for depletion of alloreactive memory T cells that may eventually result in elimination or decrease in the immunosuppressive regimen for VCA transplantation.

Small animal models of Mixed Chimerism: The principles that underlie tolerance induction through mixed chimerism induction protocol are the same for all species. Briefly, mice can be conditioned with intraperitoneal mAb injections including, anti-CD8 and anti-CD40L, anti-CD154, costim. blockade (on day 0 with respect to the BMT). This will be combined with, TBI to be given 6 h before injection of 2.5 $10^5$ bone marrow cells (BMC). The compositions and methods described herein can be used for improving mixed chimerism induction protocol in mice models.

Described herein is a CAL and/or CAR designed to target and destroy alloreactive memory T cells thereby improving the engraftment of hematopoietic stem cells and achieving durable mixed chimerism with minimal or no need for toxic preconditioning protocols. To test this multi-pronged approach, we will first evaluate two different strategies of targeting alloreactive memory T cells. The first approach is to design a CAL and/or CAR system that will specifically attack memory T cells through surface markers that uniquely identify this cell population regardless of their TCR specificity. This approach will spare the other immune cells, and, thus retain a healthy immune system.

A second approach is to design CAL and/or CARs that specifically bind to alloreactive TCRs on the recipient's T cells. To do so, instead of using a single-chain variable fragments (scFvs) that is in all classical CAR T cells, we will use peptide-MHC multimers as the ligand recognition domain on the CAL and/or CAR. However, due to a large number of unique alloreactive TCR, many different CAL and/or CAR/pMHCs are needed. This poses a challenge in designing and introducing these CAL and/or CARS into T cells. To circumvent this challenge, we propose to use a two-component split CAL and/or CAR design composed of universal CAL and/or CAR and an adaptor molecule that bridges the CAL and/or CAR T cells to alloreactive T cells. The universal CAL and/or CAR comprises a scFv targeting FITC fused to TCR signaling domains. The adaptor molecules consist of pMHC tetramer fused to a FITC. The addition of pMHC tetramer will bind to the alloreactive TCR and recruit the universal CAL and/or CAR T cell to kill alloreactive T cells. This design allows us to be able to target many variants of TCR with only one CAL and/or CAR. Next, the donor MHCs will be loaded with donor tissue specific peptides that will be generated by utilizing previously published protocols. We can first design CAL and/or CARs to target mouse MHC in a humanized/skin graft mouse model.

Data-Targeting Alloreactive T-Cells with Peptide-MHC Tetramers

The following have been addressed by in vitro data:
1. Whether targeting a memory T cell by using CART+ pMHC multimer is obtainable. In this embodiment, the anti-FITC CAR expressed by the Jurkat cells is a CAR and the pMHC multimer is a CAL.
   A. Would the Tetramer efficiently bind to the CAL and/or CAR and target T cells?
   B. Would the Jurkat CAL and/or CAR T cells get activated by attaching to the adaptor+Target
   C. Would the Target OT I cells get activated and try to kill the Killer Target T cells?
2. Whether killing a memory T cell with primary CD8 T cell+pMHC multimer would be feasible?
   1. Peptide-MHCs Tetramers Activate Jurkat Cells but not the Target Cells We used anti-FITC CAR Jurkat cells. These cells are an immortalized line of T lymphocyte cells that are used to study activation, signaling, and expression of various chemokine receptors of T cells. Jurkat cells cannot act as a killer cell but will respond to and get activated by the ligands in the same way as actual T cells. FIG. 1 shows tetramers attaching to and staining OTi target T cells in a dose dependent fashion.

The anti-FTC CAR Jurkat cells used in these experiments comprise the following nucleotide sequence and express the following polypeptide sequence.

```
DNA sequence of anti-FITC CAR. Nucleotides 1-9 =
Kozak sequence. Nucleotides 10-78 = CD8a leading
peptide. Nucleotides 79-831 = anti-FITC ScFv.
Nucleotides 832-861 = myc. Nucleotides 874-
1008 = CD8 hinge. Nucleotides 1009-1211 = CD28.
Nucleotides 1212-1338 = 4-1BB. Nucleotides 1339-
1677 =CD3ζ. Nucleotides 1678-2388 mCHERRY.
                                    SEQ ID NO: 2747
gccgccaccATGGCCTTACCAGTGACCGCCTTGCTCCTGCCGCTGGCCTT GCTGCTCCACGCCGCCAGGCCGGCTGCAcaagttcagctcgttgaatccg gcggaaaccttgttcaaccgggggttccctccgccttagttgtgccgca tctggttttacgtttggatcatttttccatgtcatgggtgcggcaggctcc cgggggggggactcgaatgggttgcgggtcttagcgcccgatcaagcctca
```

-continued
ctcactatgcagatagcgtaaaaggcaggtttacaatctcacgagacaac gcgaagaactcagtctatcttcagatgaactctctccgagtcgaggatac ggctgtctattattgtgcacgccgctcctacgattcctcaggctacgccg ggcactttattcatacatggatgtctggggccagggaaccttggtaact gtgtctggaggaggtggatcaggggtggcggaagtggcggaggtggatc ctccgtcttgacccagccctcctcagtcagtgctgccctggccaaaagg ttacaatatcatgttcaggtagtacgtcaaacataggcaacaactacgtg agttggtaccagcaacatcctggcaaagcacctaagttgatgatctatga tgtcagtaagcggccatctggggtacccgaccgattctcaggctcaaaga gcggaaactccgcgtccctcgacataagtggcctccaatccgaggacgag gccgactactactgtgctgcttgggacgactctctctcagagtttttgtt tgggaccggtacaaaactgactgttcttgggGAACAAAAACTCATCTCAG

AAGAAGATCTGAATGGGGCCGCAACCACGACGCCAGCGCCGCGACCACCA

ACACCGGCGCCCACCATCGCGTTGCAGCCCCTGTCCCTGCGCCCAGAGGC

GTGCCGGCCAGCGGCGGGGGCGCAGTGCACACGAGGGGGCTGGACTTCG

CCTGTGATTTTTGGGTGCTGGTGGTGGTTGGTGGAGTCCTGGCTTGCTAT

AGCTTGCTAGTAACAGTGGCCTTTATTATTTTCTGGGTGAGGAGTAAGAG

GAGCAGGCTCCTGCACAGTGACTACATGAACATGACTCCCCGCCGCCCCG

GGCCCACCCGCAAGCATTACCAGCCCTATGCCCCACCACGCGACTTCGCA

GCCTATCGCTCCAAACGGGGCAGAAAGAAACTCCTGTATATATTCAAACA

ACCATTTATGAGACCAGTACAAACTACTCAAGAGGAAGATGGCTGTAGCT

GCCGATTTCCAGAAGAAGAAGAAGGAGGATGTGAACTGAGAGTGAAGTTC

AGCAGGAGCGCAGACGCCCCGCGTACAAGCAGGGCCAGAACCAGCTCTA

TAACGAGCTCAATCTAGGACGAAGAGAGGAGTACGATGTTTTGGACAAGA

GACGTGGCCGGGACCCTGAGATGGGGGGAAAGCCGAGAAGGAAGAACCCT

CAGGAAGGCCTGTACAATGAACTGCAGAAAGATAAGATGGCGGAGGCCTA

CAGTGAGATTGGGATGAAAGGCGAGCGCCGGAGGGGCAAGGGGCACGATG

GCCTTTACCAGGGTCTCAGTACAGCCACCAAGGACACCTACGACGCCCTT

CACATGCAGGCCCTGCCCCCTCGCGGCatgGTGAGCAAGGGCGAGGAGGA

TAACATGGCCATCATCAAGGAGTTCATGCGCTTCAAGGTGCACATGGAGG

GCTCCGTGAACGGCCACGAGTTCGAGATCGAGGGCGAGGGCGAGGCCGC

CCCTACGAGGGCACCCAGACCGCCAAGCTGAAGGTGACCAAGGGTGGCCC

CCTGCCCTTCGCCTGGGACATCCTGTCCCCTCAGTTCATGTACGGCTCCA

AGGCCTACGTGAAGCACCCCGCCGACATCCCCGACTACTTGAAGCTGTCC

TTCCCCGAGGGCTTCAAGTGGGAGCGCGTGATGAACTTCGAGGACGGCGG

CGTGGTGACCGTGACCCAGGACTCCTCCCTGCAGGACGGCGAGTTCATCT

ACAAGGTGAAGCTGCGCGGCACCAACTTCCCCTCCGACGGCCCCGTAATG

CAGAAGAAGACCATGGGCTGGGAGGCCTCCTCCGAGCGGATGTACCCCGA

GGACGGCGCCCTGAAGGGCGAGATCAAGCAGAGGCTGAAGCTGAAGGACG

GCGGCCACTACGACGCTGAGGTCAAGACCACCTACAAGGCCAAGAAGCCC

GTGCAGCTGCCCGGCGCCTACAACGTCAACATCAAGTTGGACATCACCTC

-continued
CCACAACGAGGACTACACCATCGTGGAACAGTACGAACGCGCCGAGGGCC

GCCACTCCACCGGCGGCATGGACGAGCTGTACAAGtaa

Peptide sequence of anti-FITC CAR. Residues
1-21 = CD8a leading peptide. Residues 22-274 =
anti-FITC ScFv. Residues 275-284 = myc. Residues
289-333 = CD8 hinge. Residues 334-401 = CD28.
Residues 402-443 = 4-1BB. Residues 444-556 = CD3ζ.
Residues 557-792 mCHERRY.

SEQ ID NO: 2748
MALPVTALLLPLALLLHAARPAAQVQLVESGGNLVQPGGSLRLSCAASGF

TFGSFSMSWVRQAPGGGLEWVAGLSARSSLTHYADSVKGRFTISRDNAKN

SVYLQMNSLRVEDTAVYYCARRSYDSSGYAGHFYSYMDVWGQGTLVTVSG

GGGSGGGGSGGGGSSVLTQPSSVSAAPGQKVTISCSGSTSNIGNNYVSWY

QQHPGKAPKLMIYDVSKRPSGVPDRFSGSKSGNSASLDISGLQSEDEADY

YCAAWDDSLSEFLFGTGTKLTVLGEQKLISEEDLNGAATTTPAPRPPTPA

PTIALQPLSLRPEACRPAAGGAVHTRGLDFACDFWVLVVVGGVLACYSLL

VTVAFIIFWVRSKRSRLLHSDYMNMTPRRPGPTRKHYQPYAPPRDFAAYR

SKRGRKKLLYIFKQPFMRPVQTTQEEDGCSCRFPEEEEGGCELRVKFSRS

ADAPAYKQGQNQLYNELNLGRREEYDVLDKRRGRDPEMGGKPRRKNPQEG

LYNELQKDKMAEAYSEIGMKGERRRGKGHDGLYQGLSTATKDTYDALHMQ

ALPPRGMVSKGEEDNMAIIKEFMRFKVHMEGSVNGHEFEIEGEGEGRPYE

GTQTAKLKVTKGGPLPFAWDILSPQFMYGSKAYVKHPADIPDYLKLSFPE

GFKWERVMNFEDGGVVTVTQDSSLQDGEFIYKVKLRGTNFPSDGPVMQKK

TMGWEASSERMYPEDGALKGEIKQRLKLKDGGHYDAEVKTTYKAKKPVQL

PGAYNVNIKLDITSHNEDYTIVEQYERAEGRHSTGGMDELYK

Next, we showed that binding of adaptors to the OTi target T cells would not activate them. To evaluate that, we looked at CD69 expression which is a general activation marker for T cells. Interestingly, although adaptor binds to and stains target T cells (FIG. 1) it did not cause activation of OTi target T cells (FIG. 2).

Figure 3:
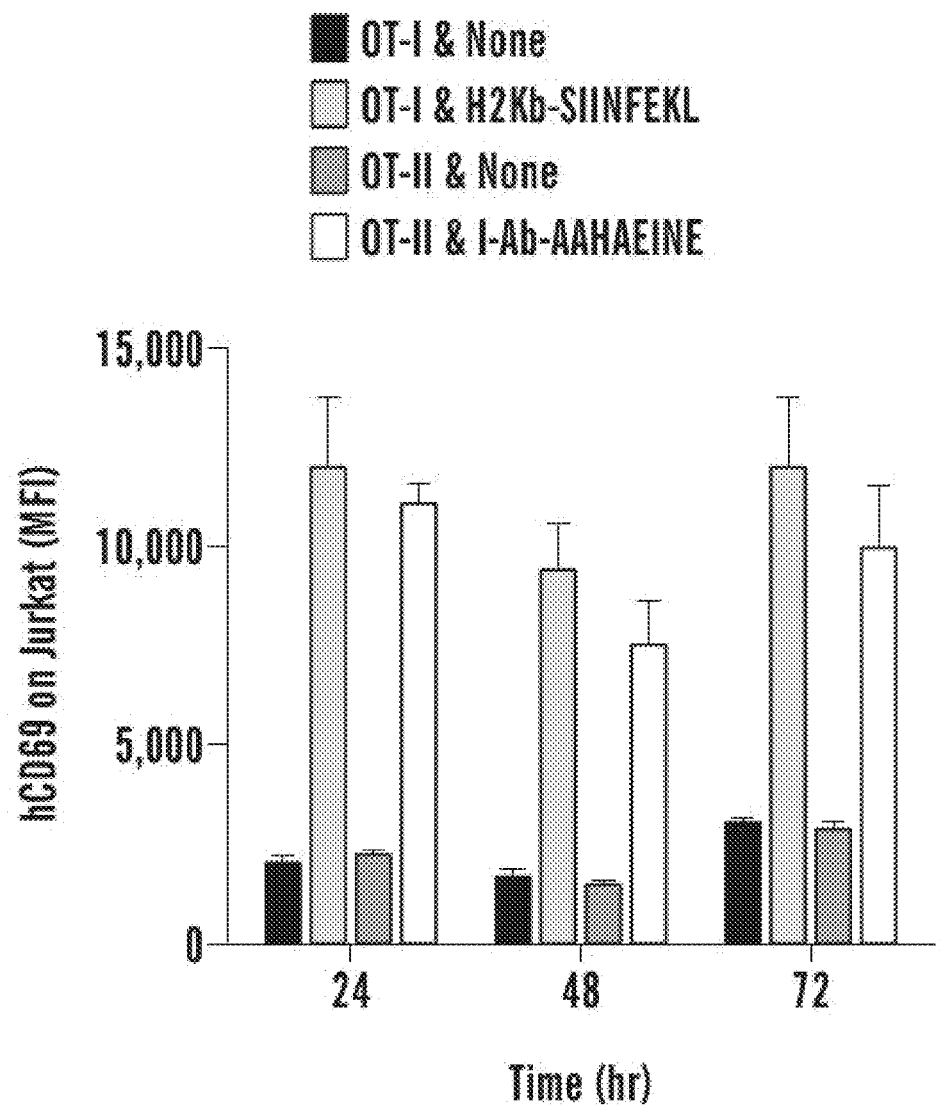
FIG. 3 depicts the expression of CD69 on Jurkat CAR, e.g., CAL T cells in different time points (24, 48, 72 hrs.). Figure discloses SEQ ID NOS 2750 and 2755, respectively, in order of appearance.

B. Subsequently, we studied the activation of Jurkat CAR T cells after binding to the adaptors. As shown in FIG. 3, binding of adaptor to the Jurkat T cells causes high expression of CD69 at all measured time points.

Figure 2:
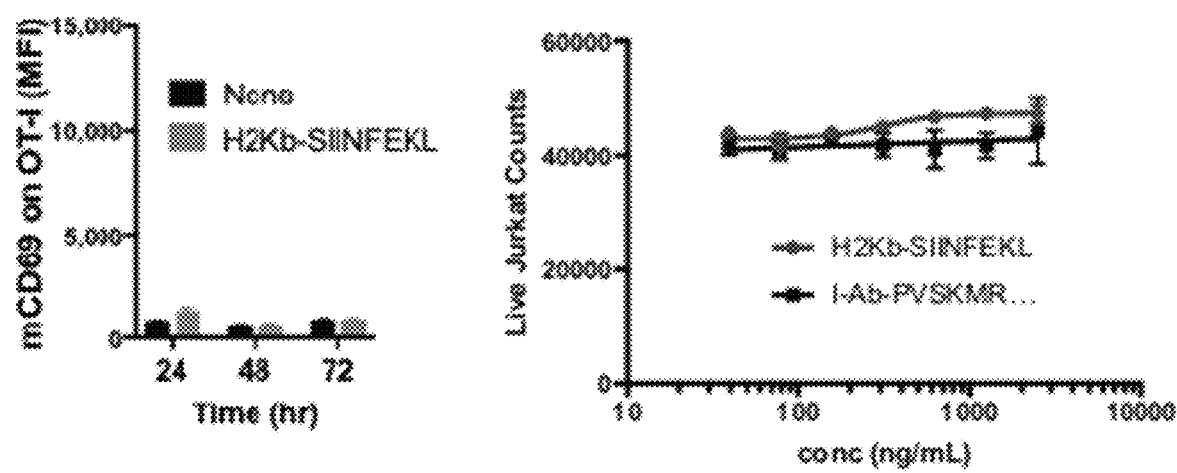
FIG. 2 depicts expression of activation marker CD69 on OTi cells at different time points (24, 48, 72 hrs.). Binding of Jurkat+ pMHC to OTi cells does not change Jurkat live count (right). Figure discloses SEQ ID NOS 2750, 2750 and 2754, respectively, in order of appearance.

This activating binding of Jurkat cells—pMHC is in contrary to the binding of OTi (target)-adaptor (FIG. 2). The best explanation for this interesting finding may lie behind the fact that FITC/anti-FITC binding between Jurkat—pMHC is much stronger than OT I—pMHC as the first one is a high affinity antigen-antibody binding and the second one is a weaker TCR-pMHC binding. This difference in the strength of binding between CAR-adaptor and Target-adaptor makes this novel approach an ideal setting for the purpose of targeting memory T cells.

C. We also looked at the Jurkat cells count after 24 hrs. as an indicator of their condition and whether this activation would cause any cell death indicated by a decrease in their numbers (FIG. 2).

2. Primary CD8 anti-FITC CAR T cells can specifically target and kill alloreactive OTi cells.

Figure 4:
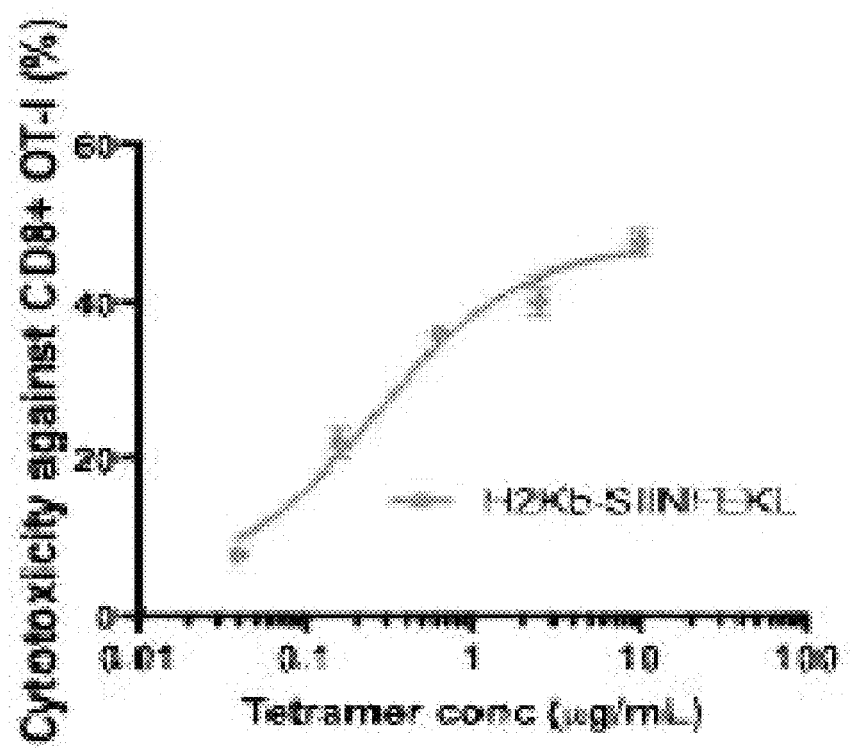
FIG. 4 depicts the cytotoxicity of Primary human CD8 CAR, e.g., CAL T cells with different concentrations of tetramers (left). Minimal activation of target cells (CD69 on CAR, e.g., CAL T cells and target cells) after coculturing with OTi cells (FIG. 2 left). I-Ab: Ctrl/H2Kb: MHC-I. Figure discloses SEQ ID NOS 2750, 2754 and 2750, respectively, in order of appearance.
Figure 4:
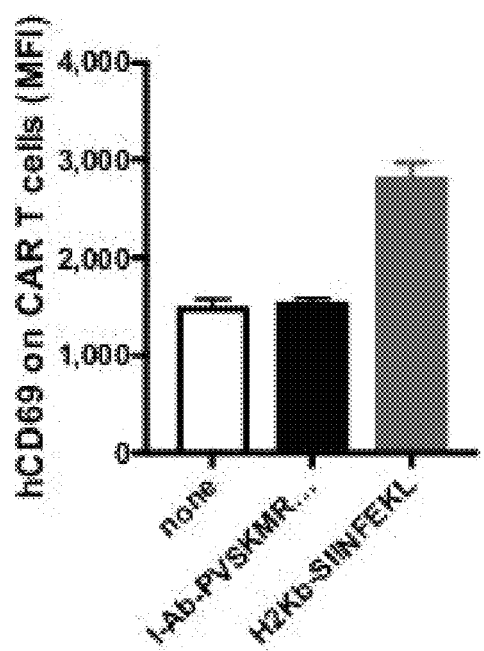
Figure 5:
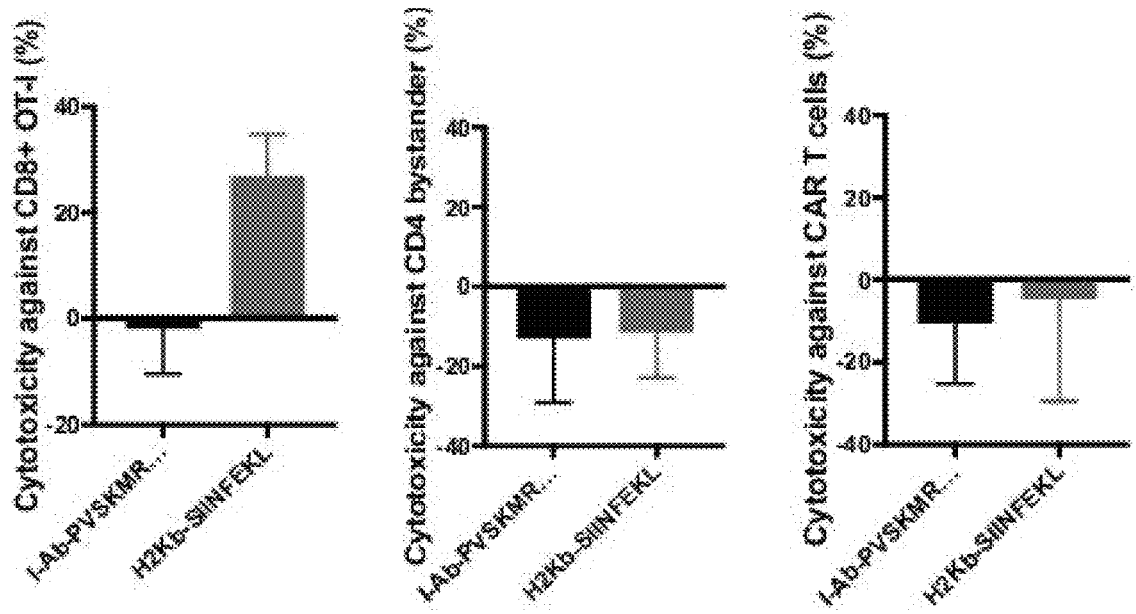
FIG. 5 demonstrates that the cytotoxicity of human CD8 CAR, e.g., CAL T is highly specific and was not seen with ctrl tetramer (left). No cytotoxicity was seen on killer CAR, e.g., CAL T cells or bystander CD4 T Cells after co-culturing with pMHC and splenocytes. Figure discloses SEQ ID NOS 2754, 2750, 2754, 2750, 2754 and 2750, respectively, in order of appearance.

The previous set of experiments with Jurkat+adaptor+OTi target cells confirmed the feasibility of targeting alloreactive T cells by adaptor molecules and showed activation of CAR T cells against the target cells. Next, we wanted to study whether primary CD8 CAR T killer cells+adaptor molecules can be used not only to identify but also to kill the OTi T cells. As shown in the previous set of experiments the binding between pMHC and target cell was not causing activation of target T cells in contrary to the adaptor (FITC+ pMHC, e.g., the CAL)—CAR T cells binding Hence, we used human primary CD8 T cells to see whether the strength of CART+adaptor (e.g, CAL)+target is enough to initiate and accomplish the killing process. Different concentrations of adaptor+CD8 CART were co-cultured with OTi T cell to see the activation and cytotoxicity of each T cell type. As shown in FIGS. 4 and 5, CD8 CART cells cytotoxicity on OTi cells is dependent on the adaptor (e.g., CAL) concentration and was over to 50% with the maximum dose that we used. Additionally, this cytotoxicity is highly specific. (FIG. 5) Human CD8 anti-FITC CART cells were used here. Similar validations can be conducted with mouse anti-FITC CARs in both in vivo and in vitro experiments.

Described herein is a novel method to use pMHC multimers for specifically targeting and destroying allo/autoreactive T cells responsible for graft rejection and autoimmune diseases. Our approach is the first demonstration of utilizing pMHC multimer (e.g, CAL) in combination with CAR T cell technology for specific targeting of alloreactive T cell population. We believe this approach is the most specific strategy for eliminating the destructive role of alloreactive T cells in transplantation. The potential application of this method extends far beyond elimination of immunosuppressants in transplantation rejection and GVHD treatment and could be applicable to many autoimmune conditions including type 1 diabetes, multiple sclerosis, rheumatoid arthritis, scleroderma, and myriad disorders that originate from auto reactive T cells dysfunction.

Provided herein is a novel approach for targeting the memory repertoire with anti CD45RO/CD127 with CAL and/or CAR T cell therapy. Although this strategy might not be as specific as using pMHC multimers, it still conveys a significant novelty. By depleting the memory T cells population there is much less of a need for induction protocols.

Also contemplated herein are individualized peptide libraries based on the differences between the recipient and the donor proteome and immune-peptidome. Hundreds to thousands of MHC-associated peptides can now be identified in a single measurement using optimal biological model systems. As mentioned earlier, studies involving MHC identical grafts indicate that minor histocompatibility antigens may also mediate rejection. Human Immuno-Peptidome Project (HIPP) is an international project that was created to accelerate research toward robust and comprehensive analysis of immunopeptidome. HIPP has published the technical guidelines that represent the information required to sufficiently conduct and interpret all of the immunopeptidomics experiments. These nonhomogeneous peptides can potentially initiate rejection through activating alloreactive T cells.

By utilizing these peptides in combination with exchangeable MHC tetramer systems, we can employ these peptides to identify and target donor reactive T cells. The default peptide on exchangeable peptide MHC systems can be removed by UV light exposure and replaced by any desired peptide. The donor multimers MI-ICs can be generated using commercially available services, unloaded with UV and then loaded with donor tissue specific peptides that will be generated by utilizing previously published protocols. By utilizing these peptides in combination with exchangeable MHC tetramer systems, we can employ these peptides to identify and target donor reactive T cells.

As described herein, selective depletion of memory T cells with CAR-T cell therapy can help in achieving durable mixed chimerism and tolerance which lead to the elimination or decrease in immunosuppressive regimens. Currently this challenge is addressed by administering intense whole-body irradiation with several immunosuppressant combinations for targeting all the immune cell populations. This shotgun approach results in severe immune compromised state in the recipient which subsequently brings myriads of side effects and complications, including opportunistic infections, reno-vascular dysfunction, and malignancies.

Memory T cells (CD127+/CD45RO+) are known to be the main contributor in rejecting allografts 2425. Hence, their depletion is expected to help engraftment of HSC and increase the survival of allografts. To investigate this hypothesis, we will generate CAL and/or CAR T-effector cell with scfv against a general marker of memory T cells (CD127+ and CD45RO+). This will be followed by induction of mixed chimerism protocol in a humanized mice model. The engraftment and stability of mixed chimerism will be followed by the presence of donor lymphoid and myeloid cells in the recipient blood stream until the study endpoints.

Activity 1.1 Generation and evaluation of AND logic CAL and/or CAR T cells to only target cells co-expressing both CD127+ and CD45RO+. Since no single surface marker can uniquely specify memory T cells, we will need to target a combination of CD markers to ensure specificity. We chose CD127 and CD45RO because they have proven to uniquely identify memory T cells 2627. To accomplish this combinatorial targeting, we will leverage an advance CAR system called SUPRA. This (SUPRA) CAR is a two-component receptor system comprises a universal receptor (zipCAR) expressed on T cells and a targeting scFv adaptor (zipFv). The zipCAR universal receptor is generated from the fusion of intracellular signaling domains (FIG. 6) and a leucine zipper as the extracellular domain. The zipFv adaptor molecule is generated from the fusion of a cognate leucine zipper and an scFv. The scFv on the zipFv binds to the antigen, while the leucine zipper binds to and activates the zipCAL and/or zipCAR on the T cells. For transplantation immunotherapy, these features can mitigate over-activation and enhance specificity.

Figures 6A, 6B:
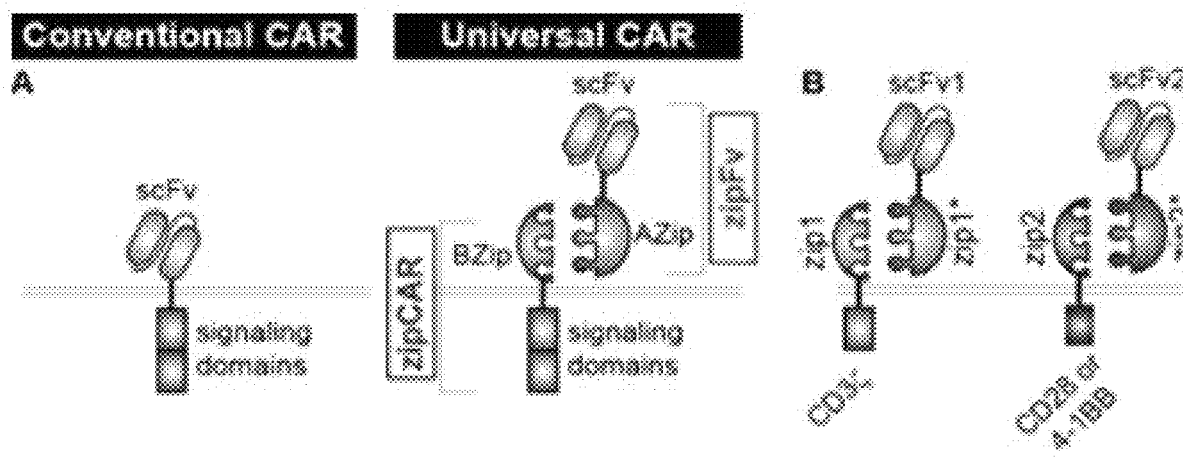
FIG. 6A depicts a schematic of SUPRA CAR design applied to provide Universal CAL. This design separates the cell targeting molecule module from the killer cell.
FIG. 6B depicts that SUPRA CARS can be designed with CD3 domain uncoupled from the costimulatory domains to provide Universal CAL as described herein.

The SUPRA CAL and/or CAR system can also be designed to perform AND combinatorial logic of antigen recognition. Orthogonal leucine zipper pairs can be used to generate CAL and/or CARS with split signaling domains (e.g., CD3z, CD28, 4-1BB), thus enabling independent and simultaneous control of these pathways (FIG. 6B). T cells need both CD3z and costimulatory signaling simultaneously to be fully activated therefore, each CAL and/or CAR can be readily paired with scFvs that target different antigens, thereby enabling two antigen combinatorial and logical antigen sensing.

Figures 7A, 7B, 7C:
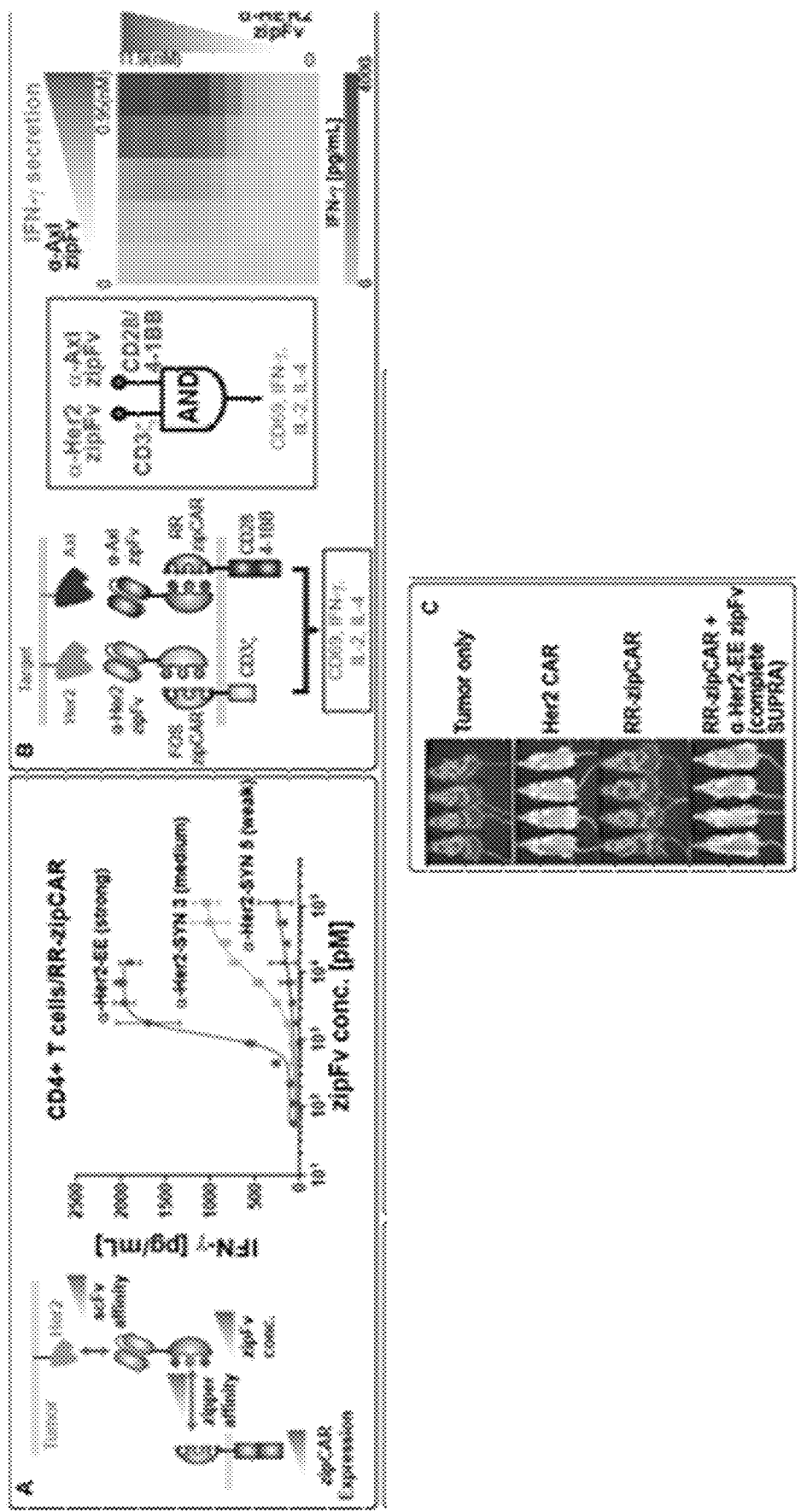
FIGS. 7A-7D depict key features of the SUPRA CAR systems that can be applied to Universal CAL.
Figure 7D:
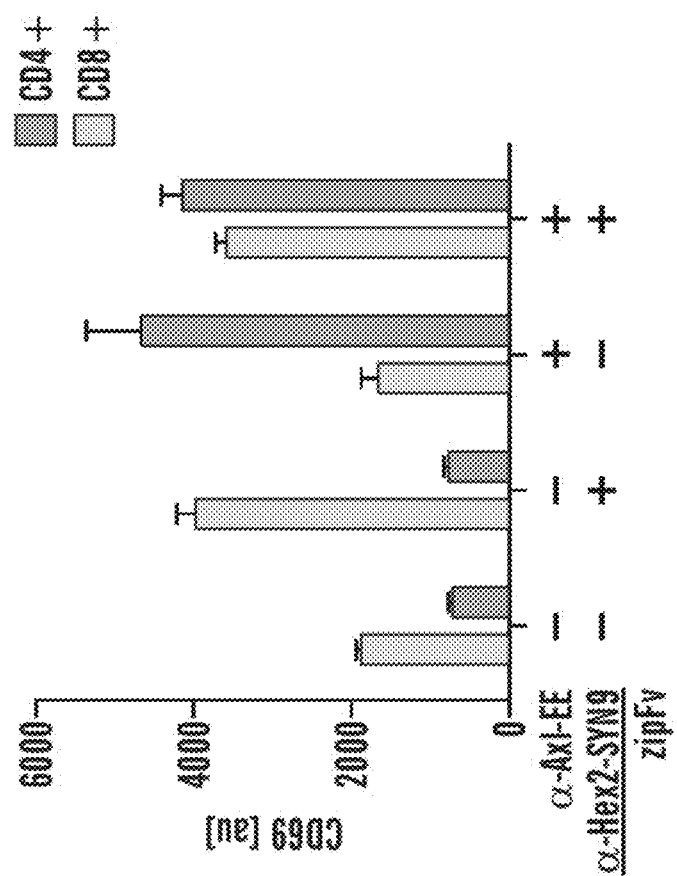
Figure 7D:
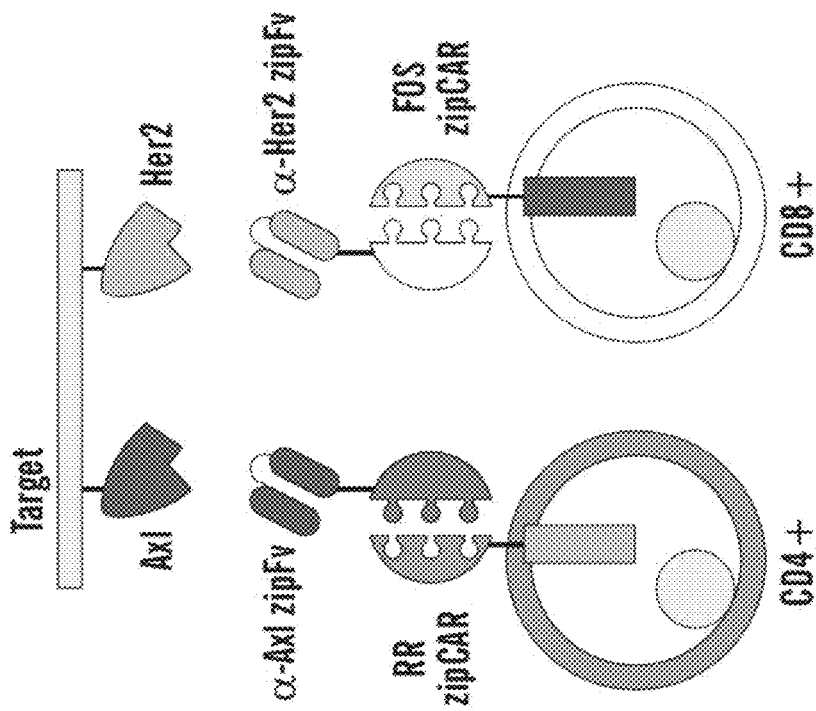

Using the SUPRA system in human primary T cells, we have demonstrated that the activity of SUPRA CARs can be finely regulated via multiple mechanisms to limit over-activation (FIG. 7). SUPRA CAR T cells can also logically respond to multiple antigens for improved target specificity. Furthermore, orthogonal SUPRA CARs can be used to inducibly regulate multiple signaling pathways or T cell subtypes to increase the breadth of immune responses that can be achieved. A summary of the SUPRA CAL and/or CAR T cell features used for this project can be found in FIGS. 6A-6B, 7A-7D.

zipCAR Receptor Construct Design: As described herein, AND logic CAL and/or CAR T are generated by fusing different leucine zippers to the hinge region of the human CD8a chain and transmembrane and cytoplasmic regions of the human CD28, or CD3z signaling endo-domains. All CAL and/or CARs can contain a myc tag to verify surface expression. Besides, these primary T cells will also be fused to mCherry after CD3z chain to visualize expression.

zipFv Construct Design: The zipFv molecules contain an scFv against CD127 fused to an SYN2 (to stimulate the CD3z SYN1 zipCAR), and an scFv against CD45RO fused to a JUN zipper (to stimulate the costimulatory FOS zip-CAR). The scfvs sequences are available and can be constructed rapidly through commercial DNA synthesis[28].

zipCAR transduction: Human PBMC are purified using separation kits. are introduced into primary human T cells via retroviral transduction. Expression of zipCARs is quantified via myc and V5-tag immunostaining and flow cytometry. As controls, a zipCAR that contains both CD3z and CD28 (i.e. SYN1-CD28-CD3z) can be used. This zipCAR cannot perform logic computation. A CD45RO-SYN2 or CD127-SYN2 zipFv can be added to ensure that zipCARs can kill CD45RO+ or CD127+ cells. These controls will also serve as reference for specificity.

Evaluate the Activity and Efficacy of Anti-CD127+/CD45RO+CAR T Cells In Vitro

Co-Culturing PBMCs with CD127+/CD45RO+ Cells with SUPRA CART Cells to Investigate the Specificity of Targeting This experiment examines whether this system specifically kills CD127+ and CD45RO+ double positive T cells amongst a large population of PBMCs. PBMCs are obtained either from known VCA recipients or Mass General Blood Bank Center after being approved by IRB. First, human CD45RO+ and CD127+ are stained to identify the initial percentage of memory cells in the whole population (CD45RO/CD127 double positive vs double neg). Next, PBMCs are co-cultured with zipCAR expressing CD8+ T cells with zipFvs (anti CD127 and anti CD45RO) with the same condition. At the study time points (24, 48, 72 hrs) significant changes in the ratio of CD45RO/CD127+/+ to −/− will be considered as an indicator of whether SUPRA CARS were efficient in targeting specific T cells rather than non-specific cytotoxic effects. Additionally, engineered T cells and zipFvs will be cocultured with the memory T cells at 3 different zipFvs concentrations (5, 25, 50 ng/well) to determine the correlation between cell killing and zipFv concentration. T cell activation (CD69 expression, IL-2 and IFN-g in the media) and cytotoxicity against memory T cells (no. of remaining live cells) will also be measured. The proliferation of T cells will be measured by cell counting. All conditions will be tested at least in triplicate.

TABLE 1 outline of experiments

| | |
|---|---|
| 1 | PBMC - Ctrl |
| 2 | PBMC + SUPRA CAR T |
| 3 | PBMC + SUPRA CAR T + scFv against CD45RO |

TABLE 1-continued outline of experiments

| | |
|---|---|
| 4 | PBMC + SUPRA CAR T + scFv against CD127 |
| 5 | PBMC + SUPRA CAR T + scFvs CD127 + CD45RO |

To evaluate and characterize the effect of memory T cells on the HSCT engraftment.

Generation of a Humanized Mouse Model with the VCA-Recipients PBMCs

To examine the effect of CD45RO/CD127 targeting with CAR T cells on the graft take and mixed chimerism sustainability, a humanized mouse model is generated by utilizing the PMBCs of VCA-recipients (FIGS. 8A, 8B). The humanized PBMC model has the fastest engraftment rate using adult PBMCs and enables studies that require a strong memory T cell function. VCA recipients' PBMCs hold an alloreactive population of memory T cells (CD45RO+/CD127+) and makes this a reliable model for studying their depletion effects on the rejection of the graft. The number of mice used per group in this study is chosen based on the recommendations from previous studies[29]. In brief, irradiated NSG (MHC I/II K/O) (3 Gy) mice will be injected with 5×105 PBMC cells and human peripheral reconstitution is measured by flow cytometry every other week[30].

Testing the effects of memory T cells depletion on mixed chimerism establishment cells in a skin graft humanized mouse model: The NSG (MHC I/II K/O) mouse model that was generated by using the VCA-recipient PBMCs are used as the foundation for induction of mixed chimerism. The presence of memory T cells in the human PBMCs of this model imitates the challenges for induction of mixed chimerism in human subjects. NSG Hu-PBMCs are treated with/without (ctrl) anti CD45RO/CD127 CAR T to deplete the memory compartment of their T cells population (FIGS. 8A, 8B).

Fetal CD34+ HSC (and skin tissue) can be obtained from Advanced Bioscience Resources. Fetal HSCs are utilized to evaluate the generation and establishment of multi-lineage engraftment by using previously published Mixed Chimerism Induction Protocols (MCIP) in mice 23. In short, male mice are treated with anti CD154, anti-CD40, CTLA-4 and receive 3 Gy TBI. Six hours later they receive 2×105CD34+ HSC bone marrow cells. Engraftment is determined by measuring the presence of donor myeloid and lymphoid cells at different time points. Mixed chimerism is defined as at least 5% of leukocytes in each of the lineages being donor derived. Less than 5% or loss of multi-lineage status is considered as failure of chimerism.

Figure 8:
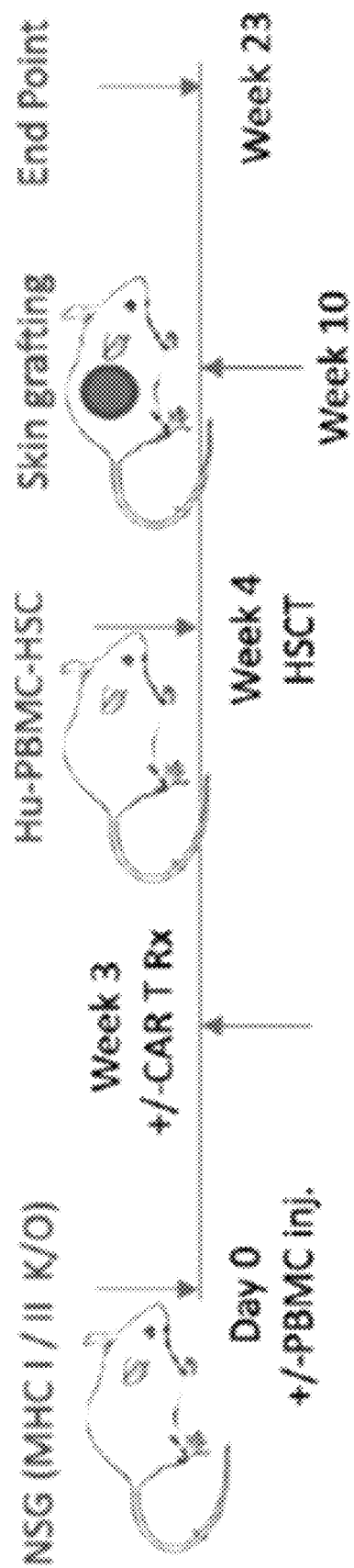
FIG. 8 depicts the timeline of double Hu-PBMC-HSCT-skin graft mouse model generation.
Figure 9:
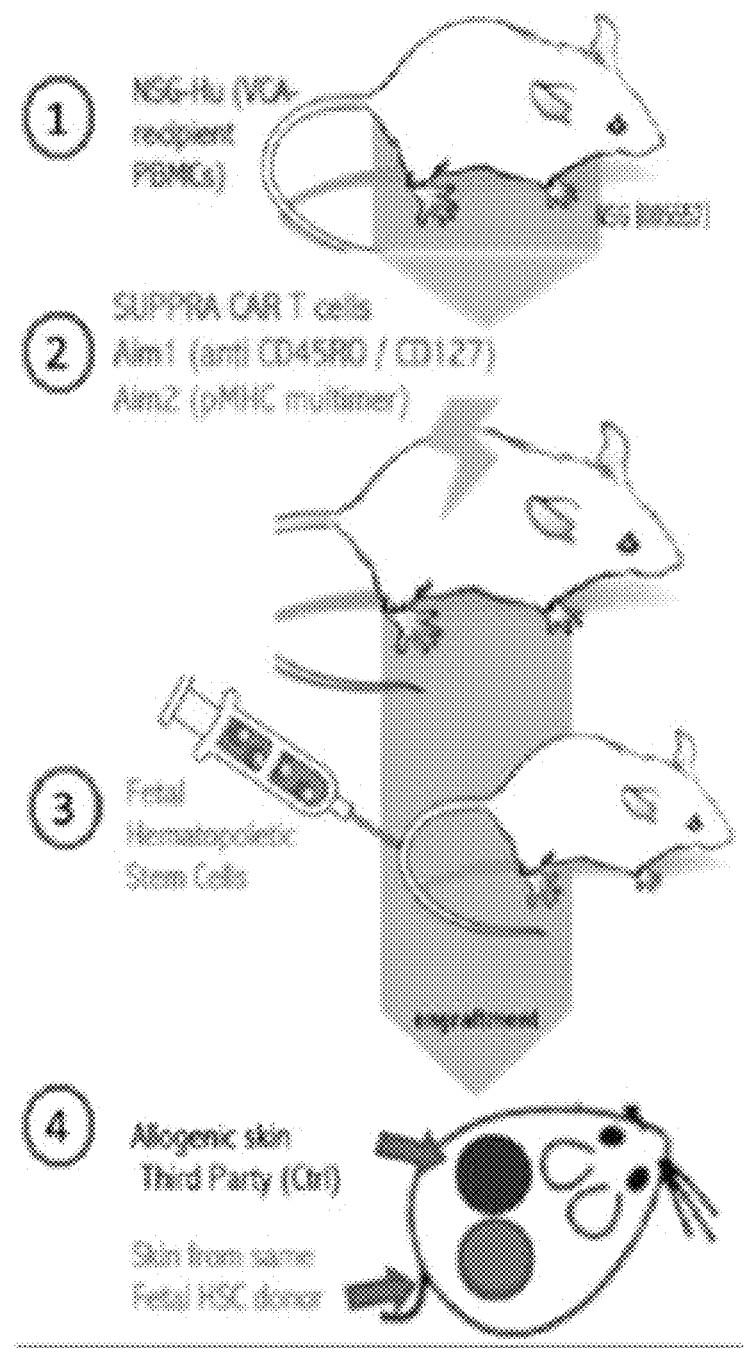
FIG. 9 depicts a summary of double hu-PBMC-HSCT-skin graft mouse model generation.
Figure 10:
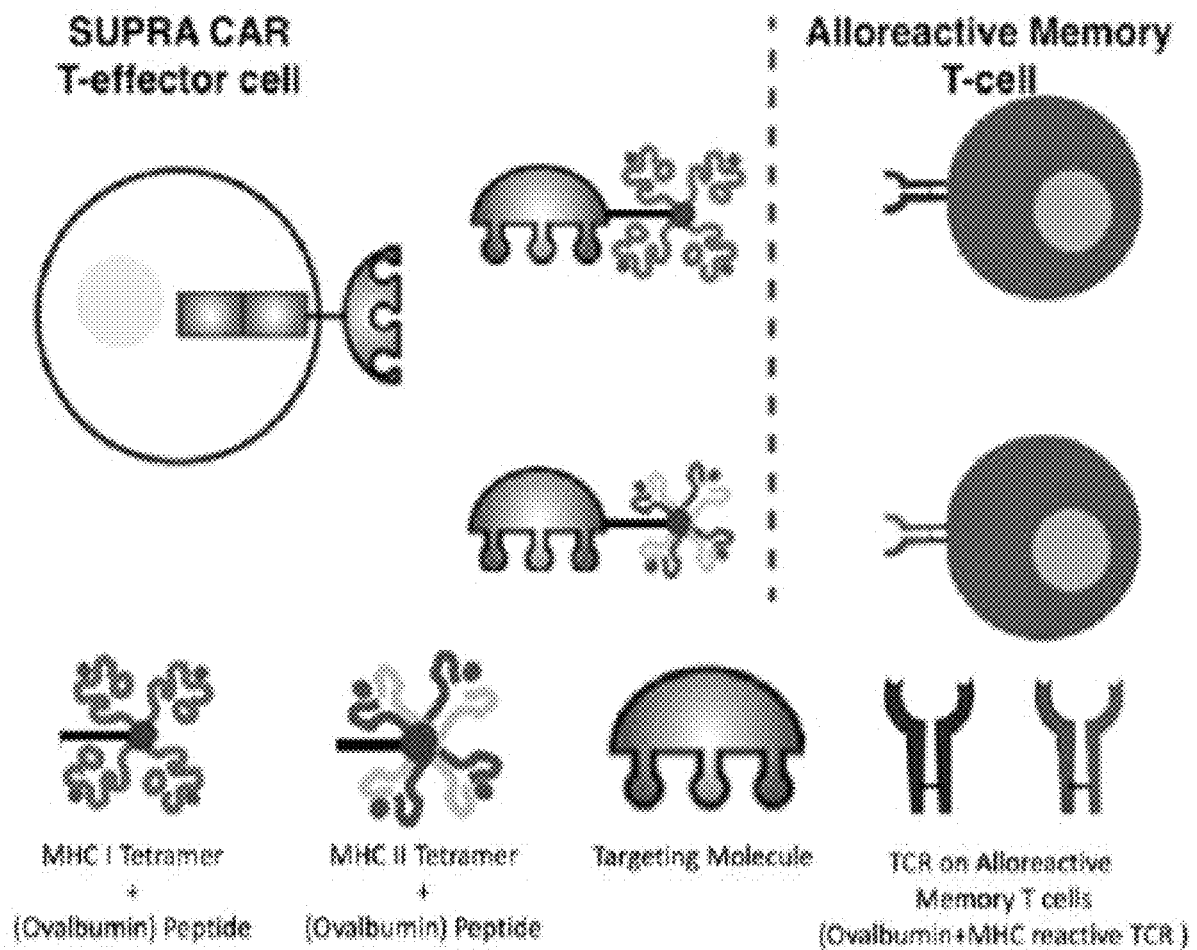
FIG. 10 depicts key features of pMHC multimer+CAR, e.g., CAL T cell system.

Next, the aforementioned humanized mouse model (VCA-Recipient PBMCs-CD34 HSC) is utilized as a skin graft model to test the effect of depleting CD45RO/CD127 cells on allograft survival. Fetal skin graft is obtained from Advanced Bioscience Resources from the same CD34+ HSC donor. At week 10 post PBMC injection, skin grafts from the HSC donor and another allogeneic source are used to test whether nonspecific depletion of memory T cell repertoire affects the skin grafts survival (FIG. 8, 9). Mice are followed until graft rejection or POD 100.

Skin grafting will be conducted using previously published protocols[31]. In short, 2 pieces of tail skin from the donor are transplanted on the back of one recipient. Following dressing removal (POD7), mice and their skin grafts are evaluated daily. Graft failure is determined by the physical appearance of the graft; including color, texture, and contour. Histology is also performed to provide supportive data regarding the clinical signs of graft rejection or engraftment. Grafts with more than 50% shrinkage in size or change in color and flexibility (dark and firm grafts) are considered as failed. Skin graft are followed for 100 days.

TABLE 2 outline of experiments

| # | N | Recipient (NSG-Hu-VCA-Rec.-PBMCs) | Mixed Chimerism | Skin Grafts |
|---|---|---|---|---|
| 1 | 8 | Control - No treatment | (MCIP) | + |
| 2 | 8 | Control - zipFv (anti CD45RO/CD127) | PBMCs + HSCT + (MCIP) | + |
| 3 | 8 | Control - SUPRA CAR T | PBMCs + HSCT + (MCIP) | + |
| 4 | 8 | SUPRA CAR T + zipFv (anti CD45RO/CD127) | PBMCs + HSCT + (MCIP) | + |
| 5 | 8 | SUPRA CAR T + zipFv (anti CD45RO/CD127) | No PBMCs + HSCT, No MCIP | + |
| 6 | 8 | SUPRA CAR T + zipFv (anti CD45RO/CD127) | No MCIP | + |
| 7 | 8 | SUPRA CAR T + zipFv (anti CD45RO/CD127) | ⅓ of regular dose MCIP | + |

Off-target toxicity occurs when T cells are not able to distinguish normal cells from target cells. In this case CD45RO is the marker that is mainly expressed on the T cells but CD127 is a more common surface marker and can be found on B and dendritic cells. Even though the "Combinatorial AND Logic" CAR system that is described herein has shown to be highly specific, there is a chance for off-target effects in this system. As an alternative approach, all of the CD45RO+ population can be targeted, which consists of not only central memory T cells but also targets effector T cells as well. This will cause more T cells to be targeted nonspecifically but simultaneously might decrease the chance of immune reaction against the graft.

Some of the CART effector cells will express memory phenotype such as CD45RO/CD127 after remaining activated for a period of time. This means that CAR T cells might attack each other after changing phenotype. Long activation of CART cells within the patient's body has always been a matter of concern. This hypothetical situation can be considered as a safety step as CART cell will clear out themselves after completing their task which is destroying memory T cells. On the other hand, if turns out to be true, this self-eliminatory phenomenon might increase the number of CAR T cells that are needed to effectively treat the patients.

Benchmark for success: Blood drawn from the vain tail (40 ul) is used every other week for the assessment of peripheral blood chimerism. Monoclonal anti-donor HLA antibody is used for monitoring of chimerism in the various leukocyte lineages, including CD3+/CD8+, CD3+/CD4+, CD3+/CD8−/CD4− (naive T cells), T-Regs, naive and mature B cells (CD19+/CD78− and CD19−/CD78+). Animals are considered chimeric when at least 5% of WBCs in all of these lineages are donor derived. Additionally, the systemic immune status of humanized mice is assessed pre-HSC transplantation and at week 4 and week 8 post-transplant by carboxyfluorescein diacetate succinimidyl ester (CFSE) mixed lymphocyte reaction (MLR) proliferation assays. MLR results are compared before PMBC-HSC transplantation and after study end point.

Determine the efficacy of pMHC-CAR T-effector cells on specific depletion of recipient alloreactive T cells and establishment of Mixed Chimerism.

Described herein is a flexible CAL and/or CAR design that can target any alloantigen specific T cells. Due to the diversity of alloantigen-specific T cells in the context of transplantation, the CAL and/or CAR system that has the flexibility to locate and attack different alloreactive T cells simultaneously. CAL and/or CAR T-eff. cells with (donor) pMHC can target alloreactive T-cells.

The Effect of CAL and/or CAR T Cell Therapy on Targeting a Double Antigen MHC System (OTi and OTii)

In short, pMHC multimer attached to adaptor molecule (e.g., the CAL)+CAR T effector cell is used in the single and double specific antigen-MHC systems. The antigen-specific CAL and/or CAR system can be tested in vitro and in the OTi & ii transgenic mouse model. This model is genetically engineered such that all T cells express receptors that are specific for recognizing chicken ovalbumin peptides (257-264 (OTi) and 329-337 (OTii) in the context of H2Kb (OTi) and I-A b (OTii)). The T cells of these mice models are engineered to express TCRs that specifically recognize pMHC class I/II+Ovalbumin peptides. More importantly, this highly controlled model can be leveraged establish correlation between T cell activities and CAL and/or CAR T cell experimental parameters, such coculture conditions, pMHC affinity, pMHC multimer concentration.

Design, build, and test anti-FITC CAR/pMHC (e.g., the CAL) system in vitro against antigen specific T cells.

As mentioned above, older generations of CAR T cells needed to be genetically redesigned to be able to recognize new or multiple targets. To overcome this challenge, mouse split universal CD8 CAR is generated as described herein. For generating mouse FITC-CAR similar steps that were described previously for human anti-FITC CAR can be utilized[20]. To evaluate the efficacy of C67BL/6 mouse anti-FITC CAR T cells efficacy, the experiments that are conducted and mentioned in the section above with human CART cells (FIG. 1-5) are repeated with mouse CART cells.

TABLE 3 outline of experiments

| Group | N | Recipient (B6-wild type + OTi/ii) |
|---|---|---|
| 1 | 6 | Control - No CAR/pMHC |
| 2 | 6 | Control + FITC pMHC multimer |
| 3 | 6 | Control + CAR T (no multimer) |
| 4 | 6 | CAR T + FITC pMHC multimer) |

Evaluate the efficacy of CAR T-eff.+FITC-pMHC tetramers (e.g. a CAL) for targeting alloreactive T-cells in the OTi and OTii transgenic mice.

Ovalbumin-pMHC-CAR T-cells effective in recognizing and destroying OTi and OTii T cells a mixture of the OTi and OTii T-cells are transferred to the wild type mice (B6) recipients. The read out of this experiment is the cell count of OTi & ii before and after CAL and/or CAR T cell therapy. The results show the effect of the CAR T-eff cells with the Ovalbumin peptide+MHC tetramer (e.g., the CAL) is successful in targeting the specific clone of OTi & ii cells.

Establish the potency of multiple peptide/multiple MHC (e.g., CAL)—CAR T cell therapy for targeting alloreactive T cell repertoire on mixed chimerism and skin graft survival.

The most significant barrier against graft take is full mismatch across MHCs of donors and recipients[32]. This challenge is addressed herein by using MHC (e.g., CAL)+CAR T cells to target alloreactive T cells. These MHC multimers are commercially available and can be readily conjugated with FITC labeling to be recognized by the anti FITC CAR T cells. Alternatively, there are many other available options for split universal CAL and/or CAR technology including leucine zippers which provide the option of tuning the affinity of the binding between adaptor (e.g., CAL) and CAR. On the other hand, Minor Histocompatibility Antigens (MiHA) are short immunogenic peptides originating from digested intra/extracellular proteins presented by Major Histocompatibility Complex (human leukocyte antigen). Disparities in minor histocompatibility antigens between individuals who are even MHC matched can induce an immune response after transplantation. These differences have shown to impede tolerance induction through mixed chimerism$_{33}$.

Generating a donor-recipient disparities peptide library for evaluating the efficacy of targeting alloreactive T cells in a humanized mouse model.

The role of the default peptides on these exchangeable-peptide MHC systems can be switched with the desired peptides (from the donor) using UV light[34,35]. The large collection of peptides associated with human leukocyte antigens (HLA) is referred to as the human immunopeptidome. The desired peptides for this study will are generated by the previously established protocols for immune-peptidome library generation[36,37,38].

Generating tissue-specific immune peptide library from the donor and recipient.

Utilizing previously established protocols we can extract and identify the immunopeptidome of the donor and the recipient. We then identify the peptide sequences that are distinctively different between the donor and the recipient using software tools (below). These disparities in the donors' and the recipients' immune-peptide sequences have the potential to mediate immune rejection. The sequences of the peptides from the donor-recipient disparity peptide library are generated in practical scale by commercially available services[39] and loaded on peptide-exchangeable MHC multimers (e.g., a CAL) (QuickSwitch MBL international or Biolegend FlexTetramer) to ultimately be bound to CAR T cells and used for targeting alloreactive T cells in the aforementioned in vitro and in vivo models (FIG. 8, 9). In brief, donor and recipient MHCs associated peptides are isolated independently by immunoaffinity purification using the anti-HLA monoclonal antibodies[36]. Eluted peptides are identified by different LC-MS/MS systems in DIA (Data Independent A) mode. Mass Spectrometry output files are converted, searched, and statistically validated using software tools (NETMHC, SysteMHC). The identified peptides are then clustered (by GibbsCluster v.1) and annotated by length and predicted MHC binding affinity (NetMHC v.4). The final list of high-confidence donor/recipient MHC-associated peptides is compared between the recipient and the donor and the disparate sequences used for building high-quality donor-recipient disparity peptide library, which is employed as a source for generating peptides to be combined with MBL QuickSwitch (or Bio-legend FlexT) MHC tetramer system.

TABLE 4 outline of experiments

| Group | N | Recipient (NSG-Hu-VCA-Rec.-PBMCs) | Mixed Chimerism | Skin Grafts |
|---|---|---|---|---|
| 1 | 8 | Control - No treatment | (MCIP) | + |
| 2 | 8 | SUPRA CAR T + FITC/(peptide MHC multimer | PBMCs + HSCT + (MCIP) | + |
| 3 | 8 | Control - SUPRA CAR T | PBMCs + HSCT + (MCIP) | + |
| 4 | 8 | SUPRA CAR T + FITC/(peptide MHC multimer) | PBMCs + HSCT + (MCIP) | + |
| 5 | 8 | SUPRA CAR T + FITC/(peptide MHC multimer) | No PBMCs + HSCT, No MCIP | + |
| 6 | 8 | SUPRA CAR T + FITC/(peptide MHC multimer) | No MCIP | + |
| 7 | 8 | SUPRA CAR T + FITC/(peptide MHC multimer) | ⅓ of regular dose MCIP | + |

Evaluating the efficacy of targeting alloreactive T cells in the multiple antigen/MHC setting on mixed chimerism establishment in a skin graft humanized mouse model.

In the actual context of allotransplantation, both MHC mismatch and MiHA will be a potential source of immune response and rejection. This experiment addresses the question of whether combing the donor-recipient disparate peptide sequences with exchangeable-peptide MHC system (e.g., a CAL) can be used in combination with split CAR T cells to target alloreactive T cells.

Prior to initiating this experiment, human fetal HSC+skin graft from the same donor is obtained from Advanced Bioscience Resources (CA, US). HLA typing of the donor cells is done and used for generating donor (FITC+exchangeable-peptide) MHC multimer. Peptides that are used with these multimer are generated based on the results of the work described above herein. Briefly, the exchangeable-peptide MHC (e.g., the CAL) is exposed to UV for the dissociation of their default UV-labile peptide. The disparity peptide library provides the desired peptides to replace the default peptide of this system. Using the same double humanized PBMC/HSCT mouse model the efficacy of this donor/recipient disparity peptide library+MHC is evaluated for specific targeting of alloreactive memory T cells and skin allograft survival. As shown in FIGS. 8A-8B, Hu-PBMC treated with exchanged peptide MHC (e.g., CAL)+CAR T.

Subsequently, HSCT with fetal HSC is performed and 6 weeks later skin from the same HSC donor is grafted on the back of the mice. Presence of mixed chimerism and graft survival is evaluated using the criteria that was mentioned earlier herein.

The immunopeptidome library is novel and has not previously been adapted for the context of transplantation. As an alternative to immunopeptidome mapping and disparity library generation, we can apply whole-peptidome (donor-recipient) disparity library, a well-known method.

Specificity and killing efficiency of CAL and/or CAR T cells, and chimerism levels can be studied in vitro and in vivo. Peripheral mechanisms of rejection or regulation can be assessed with serial mixed lymphocyte reaction (MLR) assays, at experimental endpoint. For our in vivo studies, our standard clinical definition of tolerance in rodents, which will serve as a benchmark, is rejection and immunosuppression-free survival for 100 days post-HSCT will serve as a benchmark. Skin grafts are assessed as mentioned earlier, based on the color, texture and size of shrinkage.

Impact: Described herein is a novel adaptive immune cell therapy strategy, making use of the CAL and/or CAR T-cell technology, for VCA tolerance induction. Musculoskeletal extremity injuries, including traumatic amputations are frequently seen in the pediatric burn and trauma population. These patients often struggle with severe functional and psychosocial challenges and decreased quality and quantity of life. In turn, the bottleneck to wide application of VCA, with its obvious benefits, would be lifted and effect a paradigm shift in the current management of devastating pediatric burns, which often result in severe disfigurement and amputations. Additionally, successful results enable VCA to be performed for trauma or congenital defects.

REFERENCES

1. Ziegler-Graham, K., MacKenzie, E. J., Ephraim, P. L., Travison, T. G. & Brookmeyer, R. Estimating the Prevalence of Limb Loss in the United States: 2005 to 2050. *Arch. Phys. Med. Rehabil.* 89, 422-429 (2008).
2. Hostetler, S. G., Schwartz, L., Shields, B. J., Xiang, H. & Smith, G. A. Characteristics of pediatric traumatic amputations treated in hospital emergency departments: United States, 1990-2002. *Pediatrics* 116, (2005).
3. Brandacher, G., Lee, W. P. A. & Schneeberger, S. Minimizing immunosuppression in hand transplantation. *Expert Review of Clinical Immunology vol.* 8 673-684 (2012).
4. Sachs, D. H., Kawai, T. & Sykes, M. Induction of tolerance through mixed chimerism. *Cold Spring Harb. Perspect. Med.* 4, 1-19 (2014).
5. Spitzer, T. R. et al. Combined histocompatibility leukocyte antigen-matched donor bone marrow and renal transplantation for multiple myeloma with end stage renal disease: The induction of allograft tolerance through mixed lymphohematopoietic chimerism. *Transplantation* 68, 480-484 (1999).
6. Ahmad, S. & Bromberg, J. S. Current status of the microbiome in renal transplantation. *Current Opinion in Nephrology and Hypertension vol.* 25 570-576 (2016).
7. Lellouch, A. G. et al. Abstract 68. *Plast. Reconstr. Surg.—Glob. Open* 7, 48-49 (2019).
8. Leonard, D. A. et al. Vascularized composite allograft tolerance across MHC barriers in a large animal model. *Am. J. Transplant.* 14, 343-355 (2014).
9. Lakkis, F. G. & Sayegh, M. H. Memory T cells: A hurdle to immunologic tolerance. *Journal of the American Society of Nephrology vol.* 14 2402-2410 (2003).
10. Mendenhall, S. D. et al. Prevalence and distribution of potential vascularized composite allotransplant donors, implications for optimizing the donor-recipient match. *Plast. Reconstr. Surg.—Glob. Open* 6, (2018).
11. Yigiter, K. et al. Demography and function of children with limb loss. *Prosthet. Orthot. Int.* 29, 131-138 (2005).
12. Özalp, B. & Calavul, A. Amputations in burn patients with a special emphasis on pediatric patients. *Erciyes Med. J.* 39, 7-11 (2017).
13. Jang, K. U., Joo, S. Y., Jo, J. H. & Hoon Seo, C. Burn and Amputations: A Retrospective Analysis 379 Amputation out of 19,958 Burns in 10-year. *Int. J. Phys. Med. Rehabil.* 06, (2018).
14. Benichou, G., Gonzalez, B., Marino, J., Ayasoufi, K. & Valujskikh, A. Role of memory T cells in allograft rejection and tolerance. *Front. Immunol.* 8, (2017).
15. Levesque, V. et al. B-cell-dependent memory T cells impede nonmyeloablative mixed chimerism induction in presensitized mice. *Am. J. Transplant.* (2011) doi: 10.1111/j.1600-6143.2011.03683.x.
16. Valujskikh, A. The challenge of inhibiting alloreactive T-cell memory. *American Journal of Transplantation vol.* 6 647-651 (2006).
17. Nadazdin, O. et al. Host alloreactive memory T cells influence tolerance to kidney allografts in nonhuman primates. *Sci. Transl. Med.* 3, (2011).
18. Lo, D. J. et al. Selective targeting of human alloresponsive CD8+ effector memory T cells based on CD2 expression. *Am. J. Transplant.* 11, 22-33 (2011).
19. Ng, Z. Y., Read, C., Kurtz, J. M. & Cetrulo, C. L. Memory T Cells in Vascularized Composite Allotransplantation. *Vasc. Compos. Allotransplantation* 2, 75-79 (2015).
20. Tonsho, M. et al. Tolerance of Lung Allografts Achieved in Nonhuman Primates via Mixed Hematopoietic Chimerism. *Am. J. Transplant.* (2015) doi:10.1111/ajt.13274.
21. Hofmann, K., Clauder, A. K. & Manz, R. A. Targeting B cells and plasma cells in autoimmune diseases. *Frontiers in Immunology* (2018) doi:10.3389/fimmu.2018.00835.
22. Ehlers, M. R. & Rigby, M. R. Targeting Memory T Cells in Type 1 Diabetes. *Current Diabetes Reports* (2015) doi:10.1007/s11892-015-0659-5.
23. Rezvani, K., Rouce, R., Liu, E. & Shpall, E. Engineering Natural Killer Cells for Cancer Immunotherapy. *Molecular Therapy* (2017) doi: 10.1016/j.ymthe.2017.06.012.
24. Fesnak, A. D., June, C. H. & Levine, B. L. Engineered T cells: The promise and challenges of cancer immunotherapy. *Nature Reviews Cancer vol.* 16 566-581 (2016).
25. June, C. H., O'Connor, R. S., Kawalekar, O. U., Ghassemi, S. & Milone, M. C. CART cell immunotherapy for human cancer. *Science vol.* 359 1361-1365 (2018).
26. Cho, J. H., Collins, J. J. & Wong, W. W. Universal Chimeric Antigen Receptors for Multiplexed and Logical Control of T Cell Responses. *Cell* 173, 1426-1438.e11 (2018).
27. Yang, J. et al. Allograft rejection mediated by memory T cells is resistant to regulation. *Proc. Natl. Acad. Sci. U.S.A.* 104, 19954-19959 (2007).
28. Levesque, V. et al. B-cell-dependent memory T cells impede nonmyeloablative mixed chimerism induction in presensitized mice. *Am. J. Transplant.* 11, 2322-2331 (2011).

29. Farber, D. L., Yudanin, N. A. & Restifo, N. P. Human memory T cells: Generation, compartmentalization and homeostasis. *Nature Reviews Immunology* vol. 14 24-35 (2014).
30. Thome, J. J. C. et al. Spatial map of human t cell compartmentalization and maintenance over decades of life. *Cell* 159, 814-828 (2014).
31. Antibodies directed against cd127.
32. Yong, K. S. M., Her, Z. & Chen, Q. Humanized Mice as Unique Tools for Human-Specific Studies. *Archivum Immunologiae et Therapiae Experimentalis* (2018) doi:10.1007/s00005-018-0506-x.
33. Xia, J. et al. Modeling Human Leukemia Immunotherapy in Humanized Mice. *EBioMedicine* 10, 101-108 (2016).
34. Pakyari, M. et al. A new method for skin grafting in murine model. *Wound Repair Regen.* 24, 695-704 (2016).
35. Murray, A. G. et al. Human T-cell-mediated destruction of allogeneic dermal microvessels in a severe combined immunodeficient mouse. *Proc. Natl. Acad. Sci. U. S. A.* (1994) doi:10.1073/pnas.91.19.9146.
36. Morris, H. et al. Tracking donor-reactive T cells: Evidence for clonal deletion in tolerant kidney transplant patients. *Sci. Transl. Med.* (2015) doi:10.1126/scitranslmed.3010760.
37. Birnbaum, M. E. et al. Deconstructing the peptide-MHC specificity oft cell recognition. *Cell* (2014) doi:10.1016/j.cell.2014.03.047.
38. Gee, M. H. et al. Antigen Identification for Orphan T Cell Receptors Expressed on Tumor-Infiltrating Lymphocytes. *Cell* (2018) doi:10.1016/j.cell.2017.11.043.
39. Ledsgaard, L., Kilstrup, M., Karatt-Vellatt, A., McCafferty, J. & Laustsen, A. H. Basics of antibody phage display technology. *Toxins* (2018) doi:10.3390/toxins10060236.
40. Luimstra, J. J. et al. A flexible MHC class I multimer loading system for large-scale detection of antigen-specific T cells. *J. Exp. Med.* 215, 1493-1504 (2018).
41. Cherf, G. M. & Cochran, J. R. Applications of yeast surface display for protein engineering. *Methods Mol. Biol.* (2015) doi:10.1007/978-1-4939-2748-7_8.

Example 9

Jurkat+pMHC—OTi

Described herein is the investigation of whether killer CART cells activation by binding to the adaptor (pMHC, e.g, a CAL))+Target. The experimental design is depicted in FIG. 11.

Figure 12:
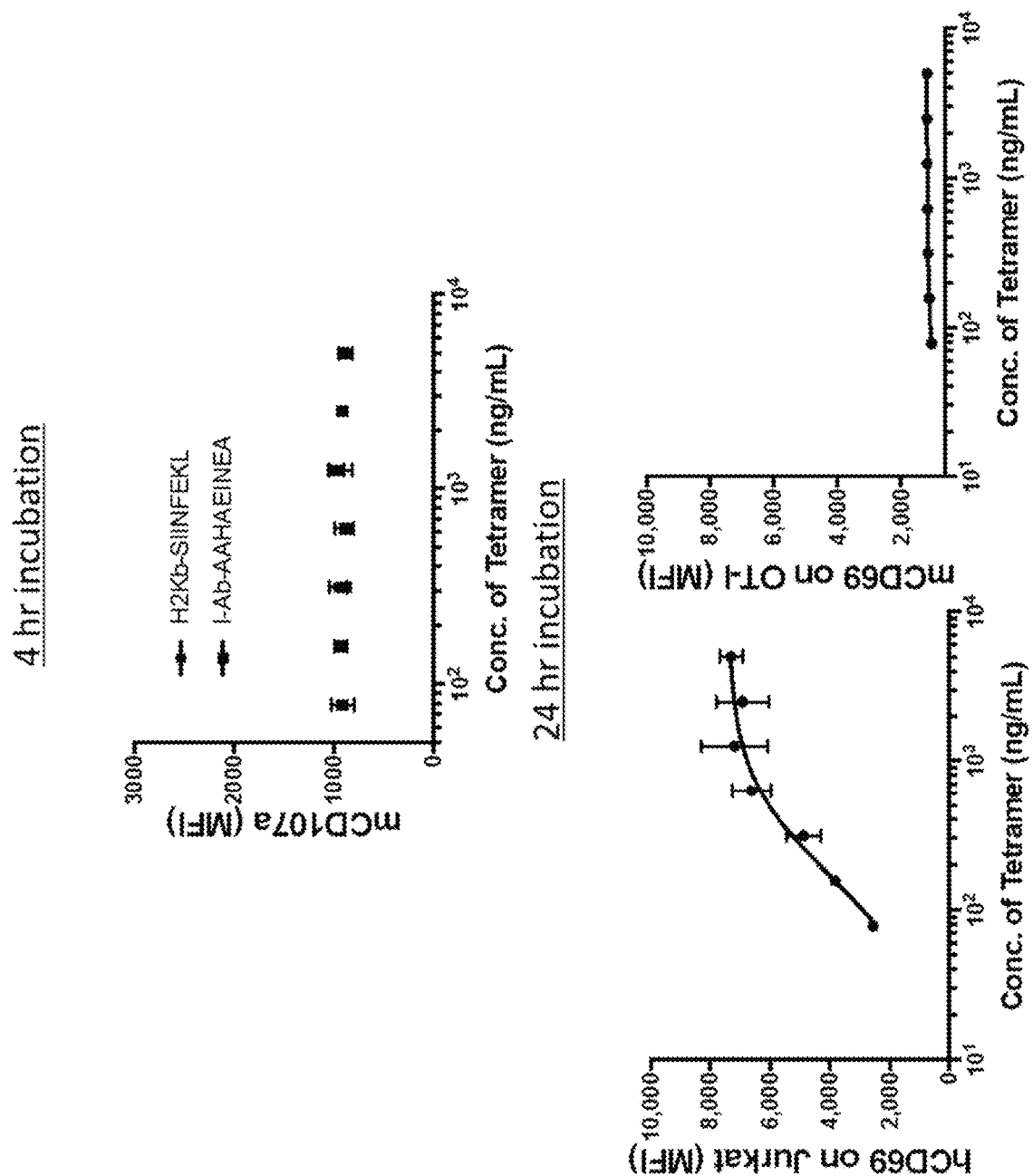
FIG. 12 demonstrates verification of FITC-conjugated tetramer mediated activation. Figure discloses SEQ ID NOS 2750 and 2751, respectively, in order of appearance.
Figure 13:
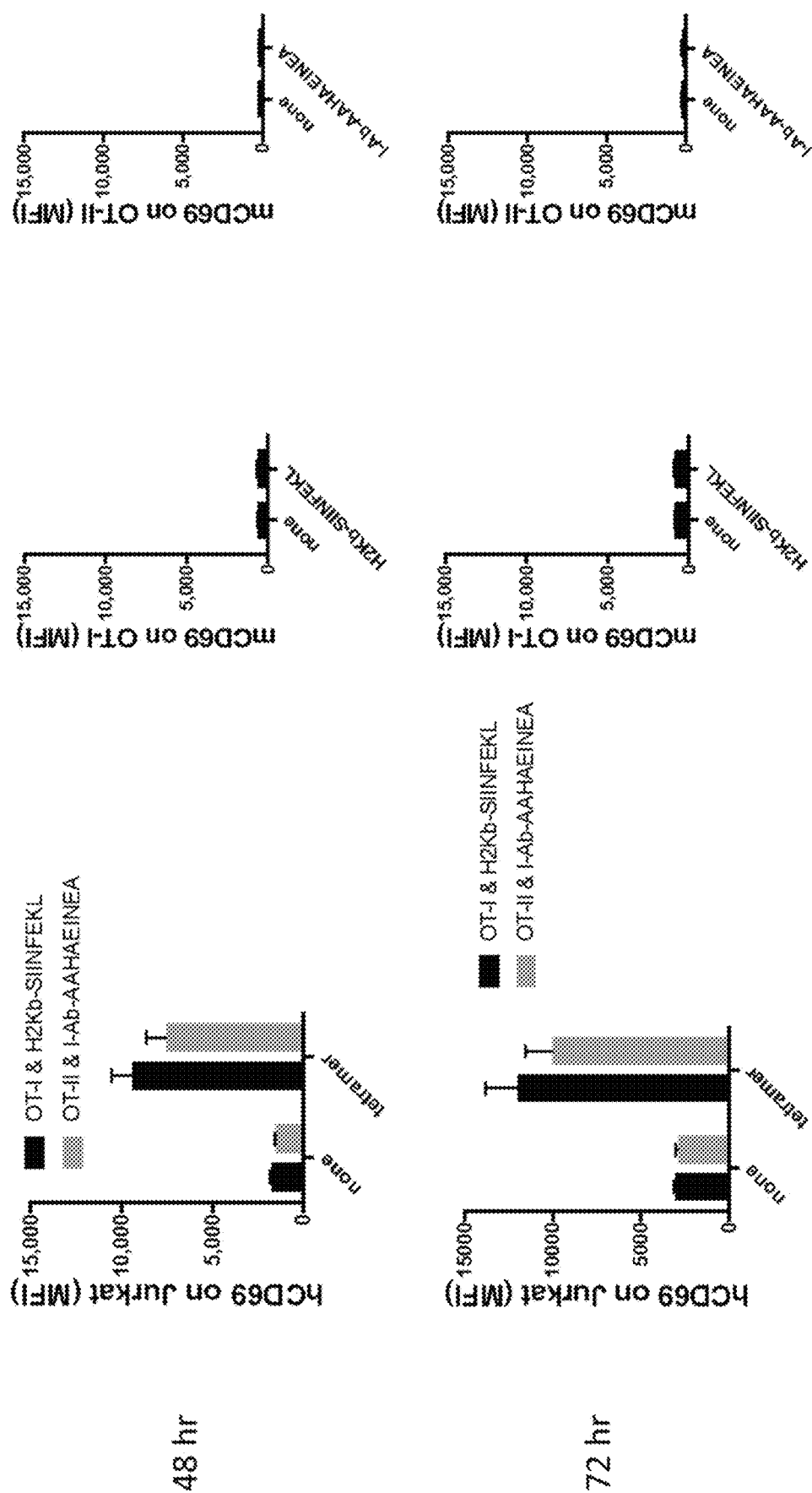
FIG. 13 depicts a time course of FITC-conjugated tetramer mediated activation. Figure discloses SEQ ID NOS 2750, 2751, 2750, 2751, 2750, 2751, 2750 and 2751, respectively, in order of appearance.
Figure 14:
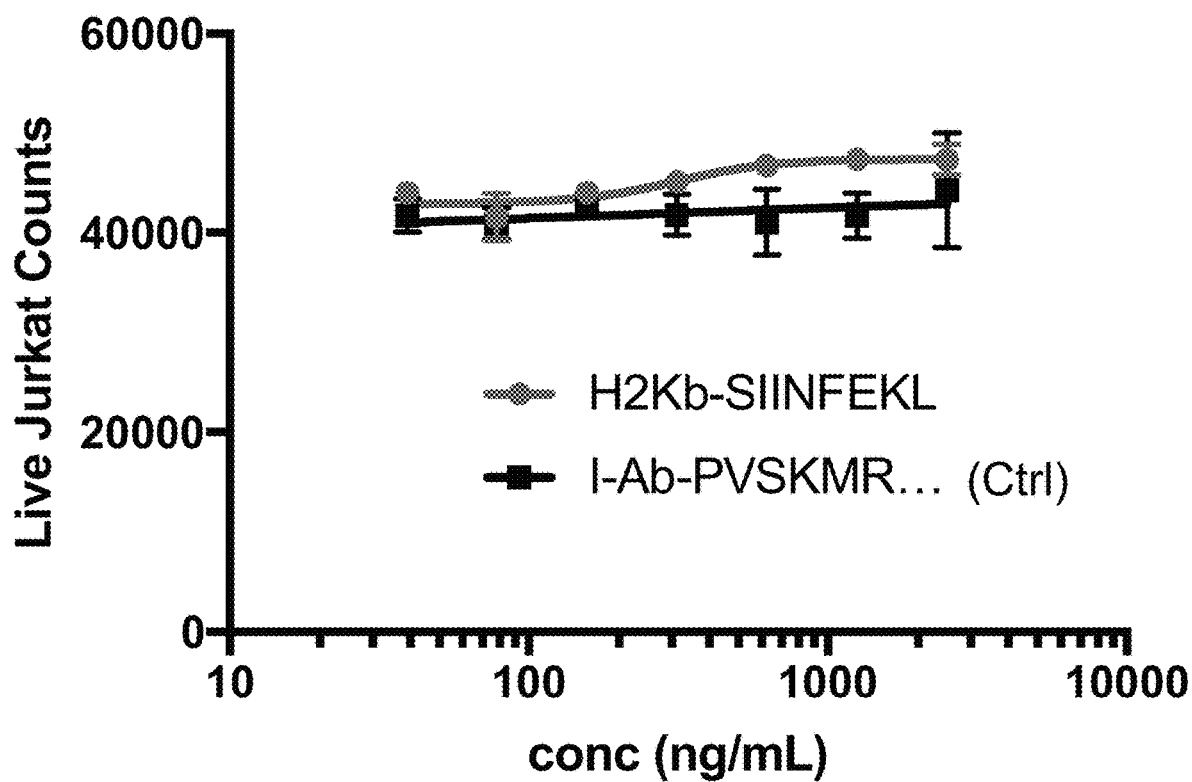
FIG. 14 depicts a graph of Jurkat cell counts. Figure discloses SEQ ID NOS 2750 and 2754, respectively, in order of appearance.
Figure 15:
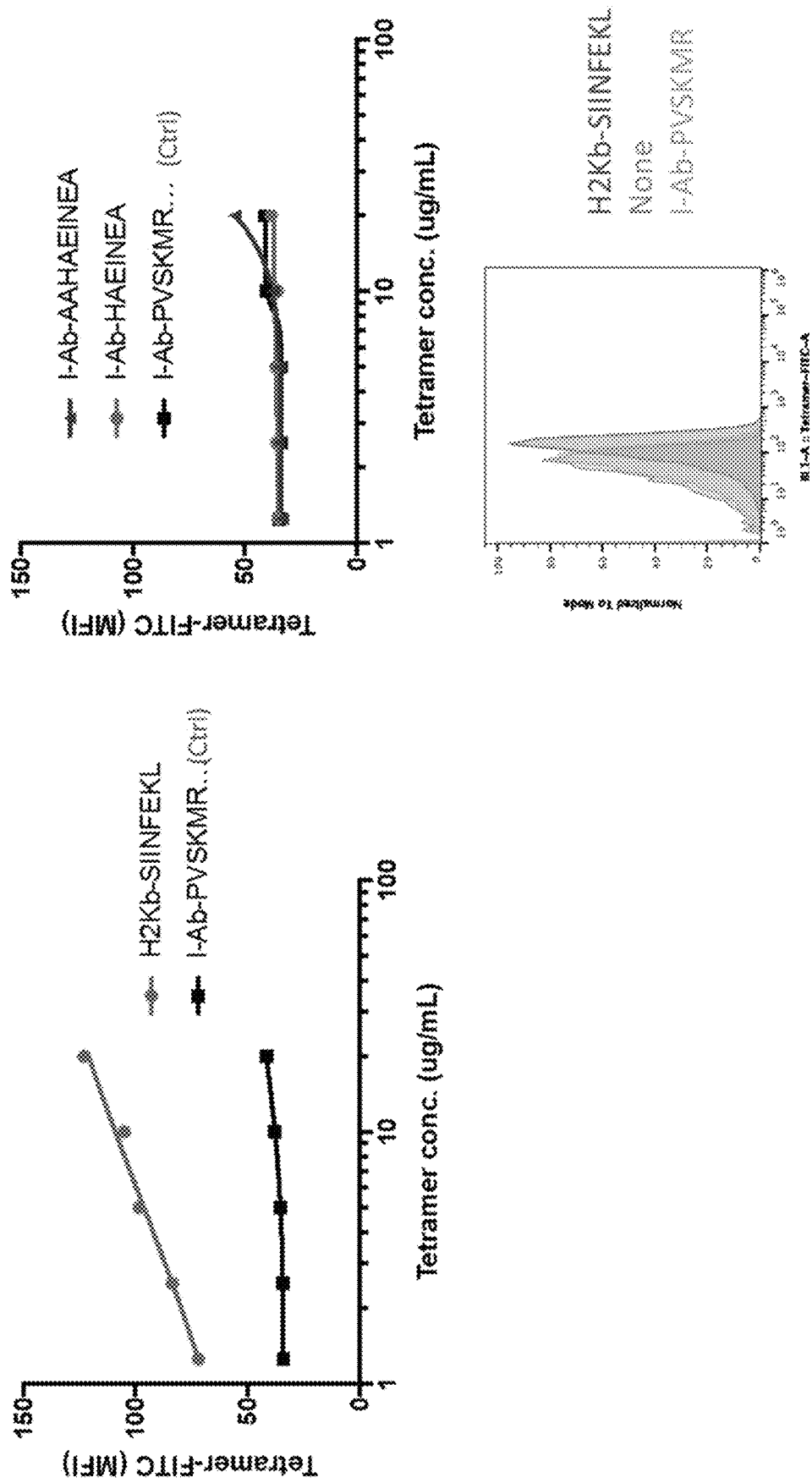
FIG. 15 depicts tetramer staining. Figure discloses SEQ ID NOS 2750, 2754, 2751, 2756, 2754, 2750 and 2754, from left to right and top to bottom.
Figure 16:
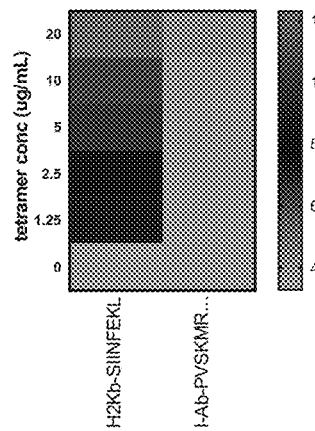
FIG. 16 depicts heatmaps of indicated staining levels. Figure discloses SEQ ID NOS 2751, 2757, 2754, 2750, 2754, 2751, 2754, 2757, 2750, 2754, 2751, 2754, 2757, 2750 and 2754, respectively, in order of appearance.
Figure 16:
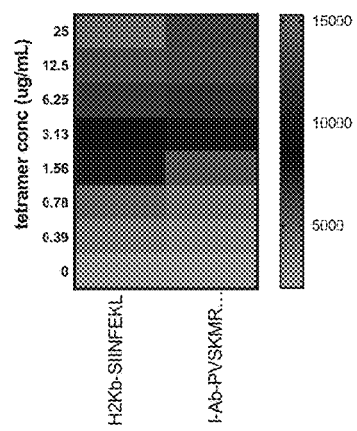
Figure 16:
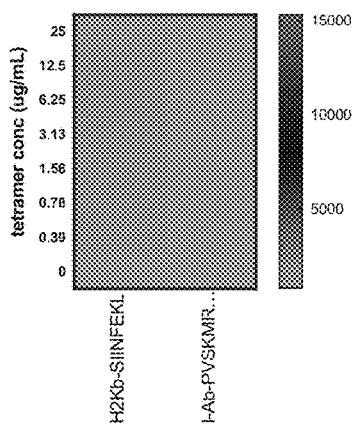
Figure 16:
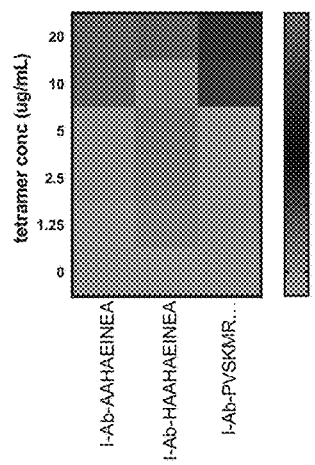
Figure 16:
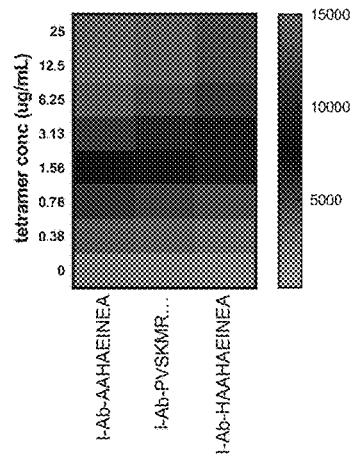
Figure 16:
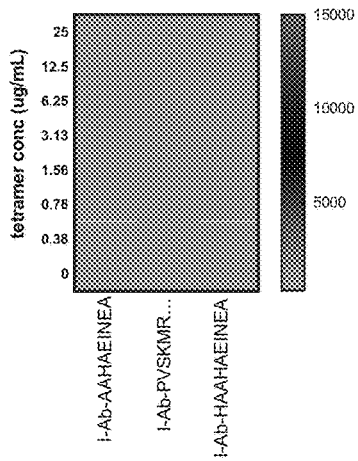

FITC-conjugated tetramer mediated activation was verified (FIG. 12) and followed in a time course (FIG. 13). Anti-FITC Jurkat vs OT-I experiments were conducted using 100k cells anti-FITC CAR Jurkat, 100k cells splenocytes from OT-I mouse, and 5 ug/mL to 78 ng/mL FITC-conjugated tetramer (positive, H2Kb-SIINFEKL (SEQ ID NO: 2750); negative, I-Ab-AAHAEINEA (SEQ ID NO: 2751)). Total Jurkat cell counts at 24 hours (FIG. 14) and tetramer staining levels (FIG. 15) were also determined. The levels of tetramer and CD69 were also determined (FIG. 16).

This experiment demonstrated that Jurkat cells get activated in a dose dependent fashion up to 1 ug/ml of tetramer and OTi binding and staining is dose dependent. No cytotoxicity effects were seen on the killer cells and no prominent activation was seen on the target cells.

Primary T Cells—OTi

Figure 18:
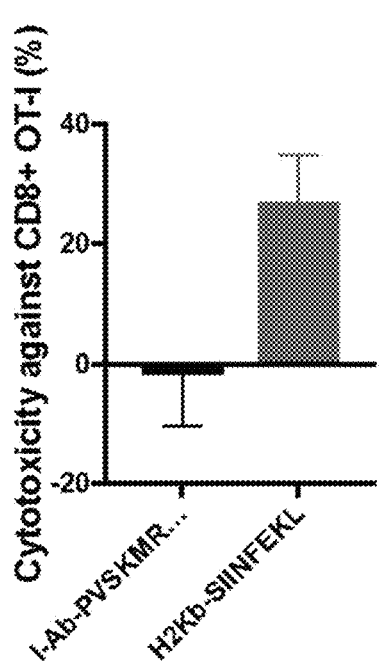
FIGS. 18-20 depict graphs of cytotoxicity levels.
Figure 18:
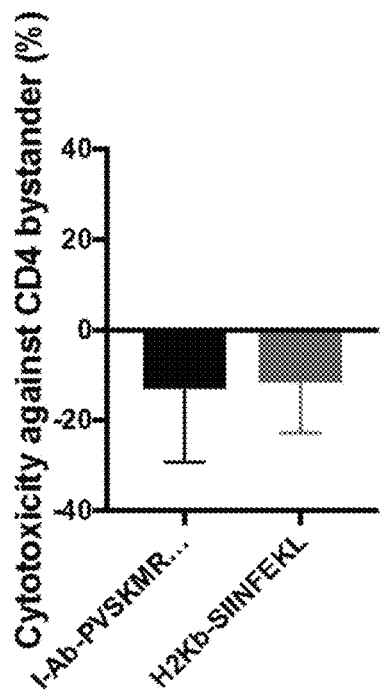
Figure 19:
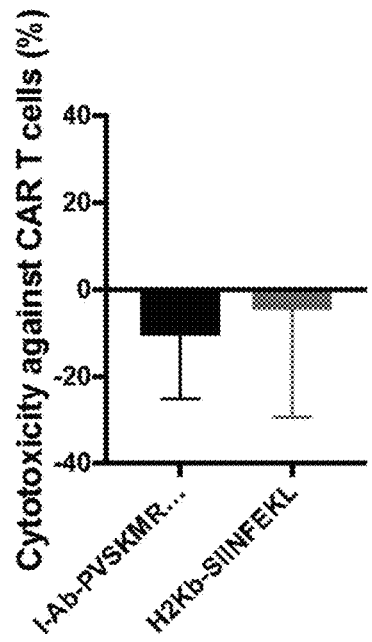
Figure 20:
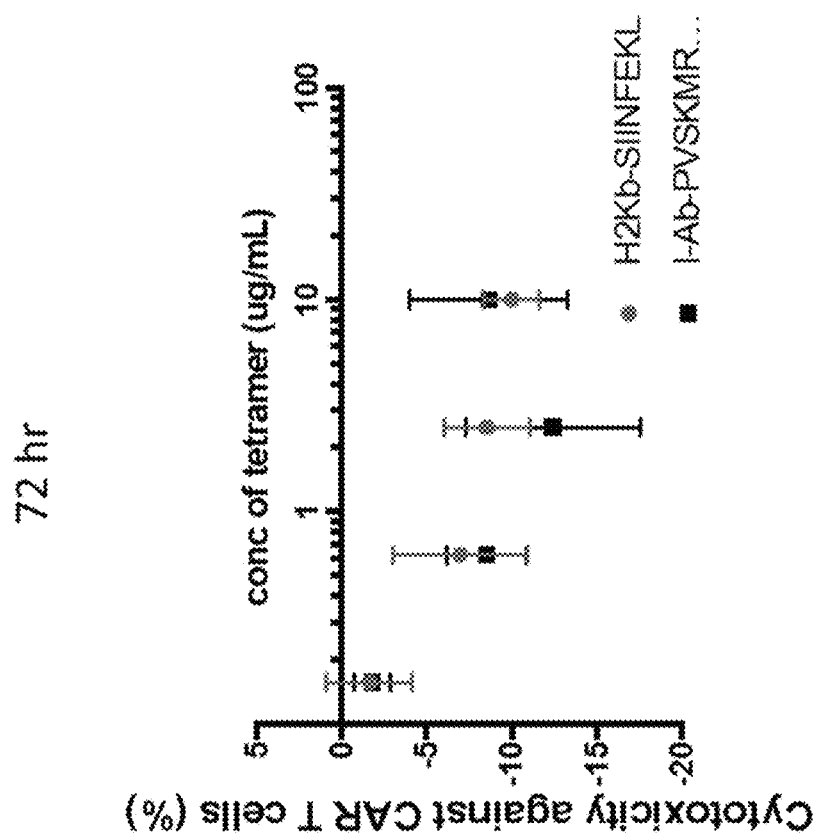
Figure 20:
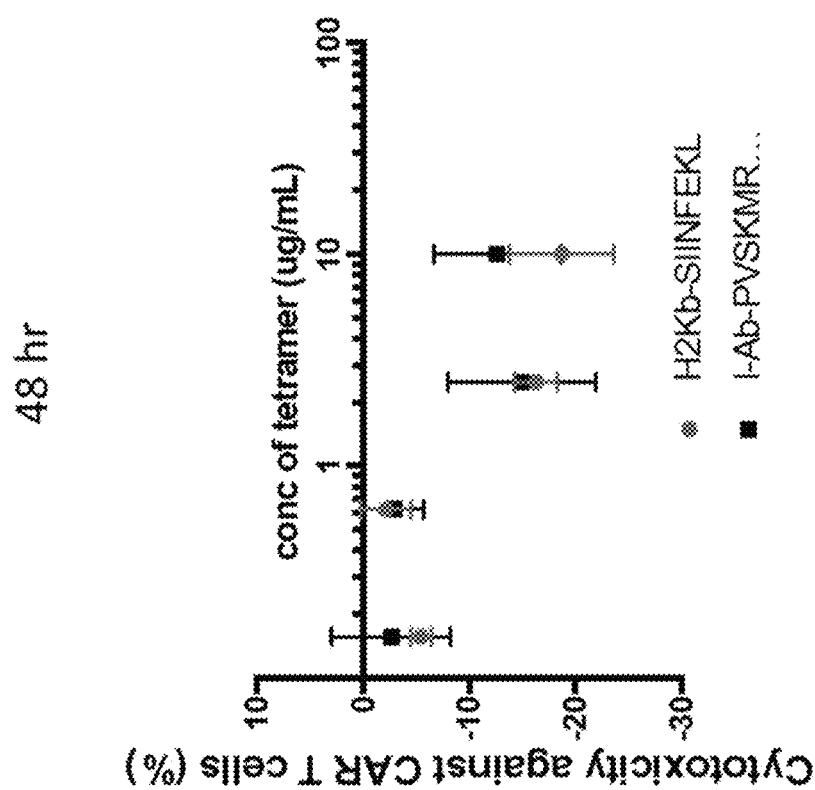
Figure 21:
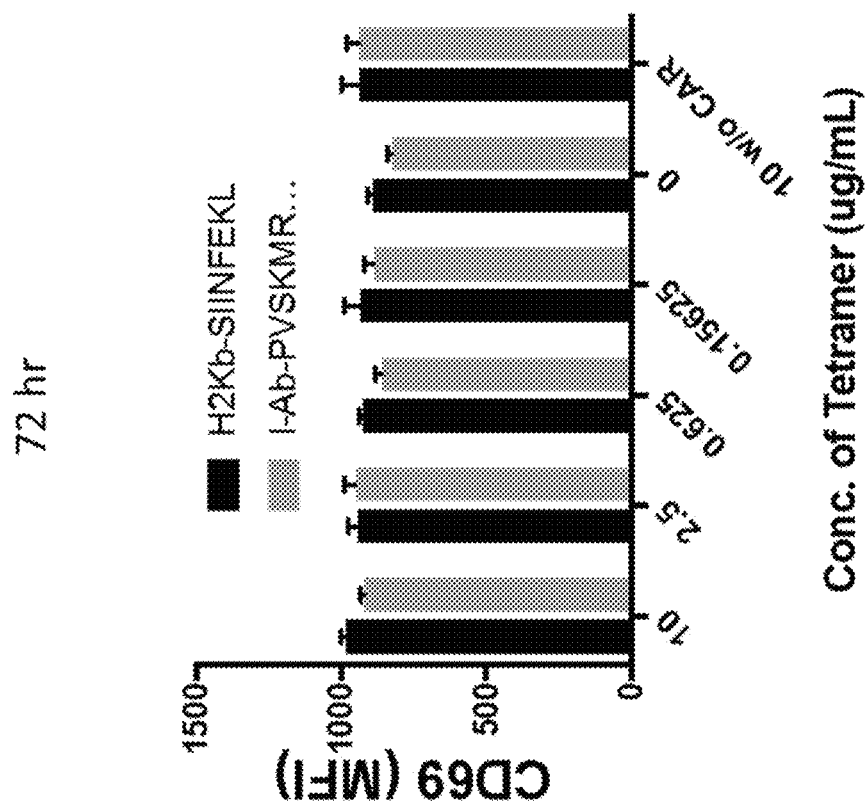
FIG. 21 depicts the levels of CD69 on OTi CD8 T cells. Figure discloses SEQ ID NOS 2750, 2754, 2750 and 2754 from left to right.
Figure 21:
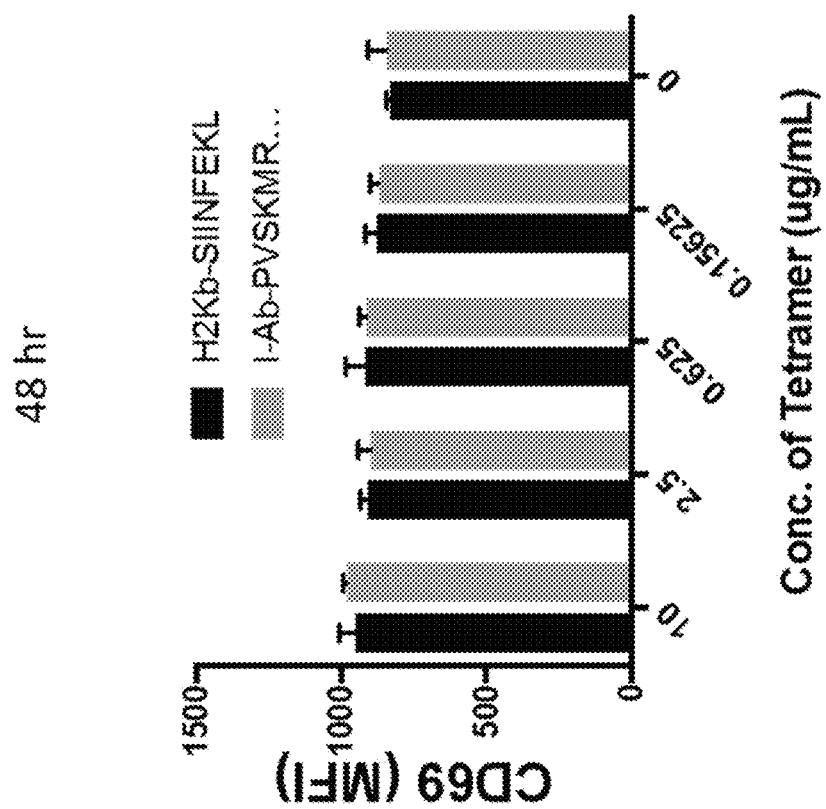
Figure 22:
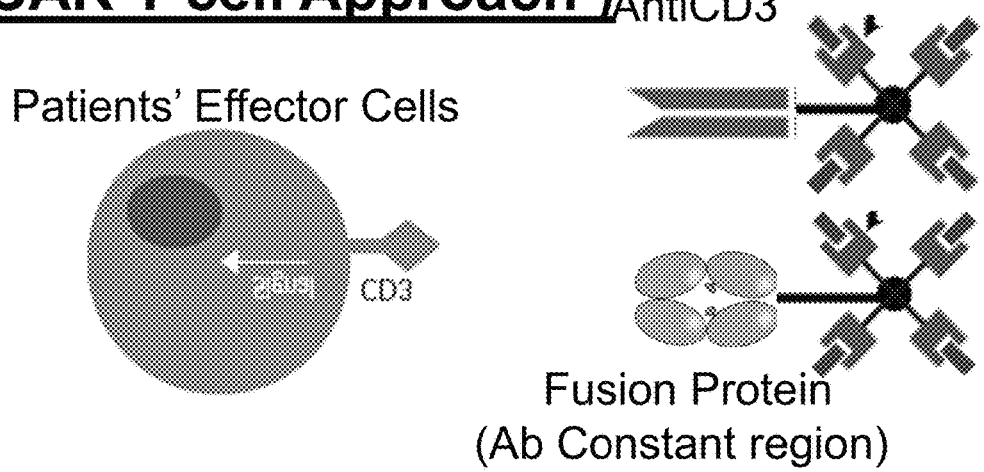
FIG. 22 depicts schematics of two embodiments of the technology described herein.
Figure 22:
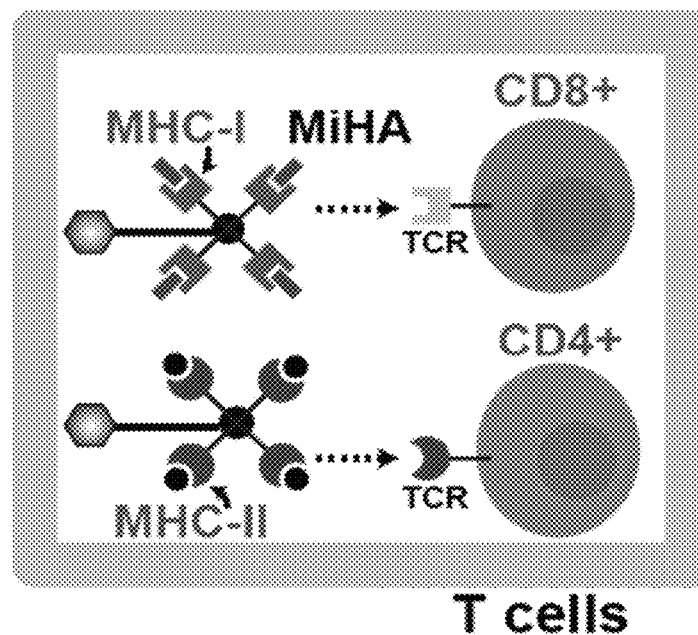
Figure 23:
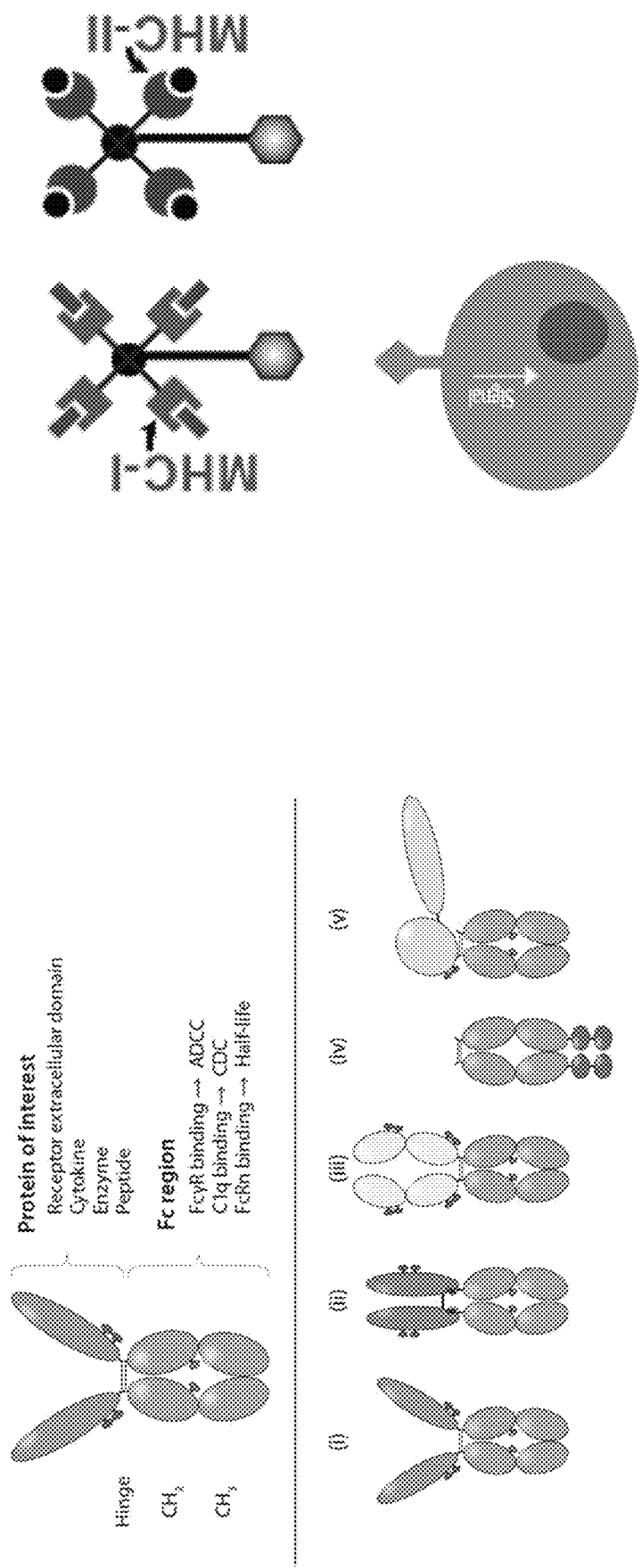
FIG. 23 depicts a schematic of the FU-CAL embodiments of the technology described herein.
Figure 24:
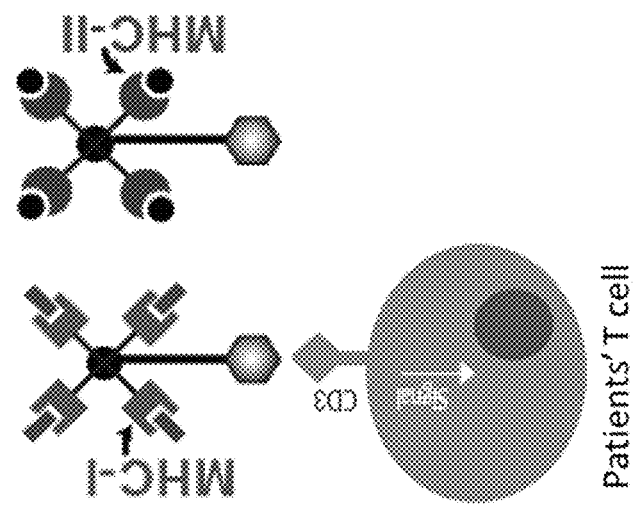
FIG. 24 depicts a schematic of the CAL-BITE embodiments of the technology described herein. The left panel depicts blinatumomab, which is described in more detail in Weiner et al. The Molecular Basis of Cancer 2015 683-694.e3.
Figure 24:
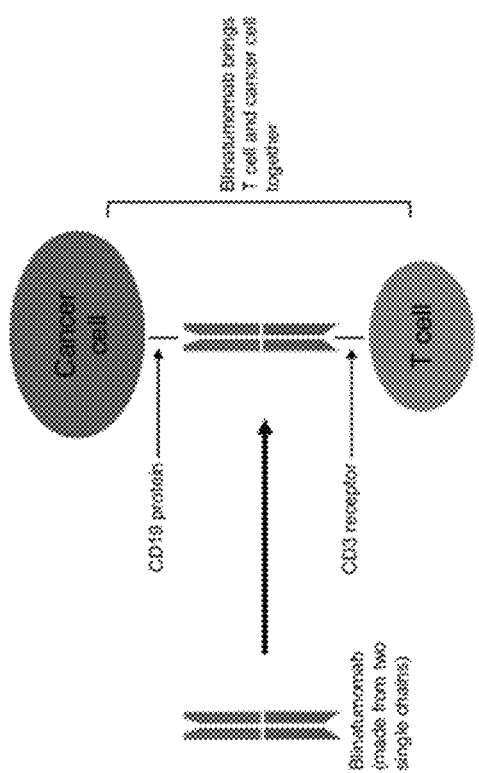
Figure 25:
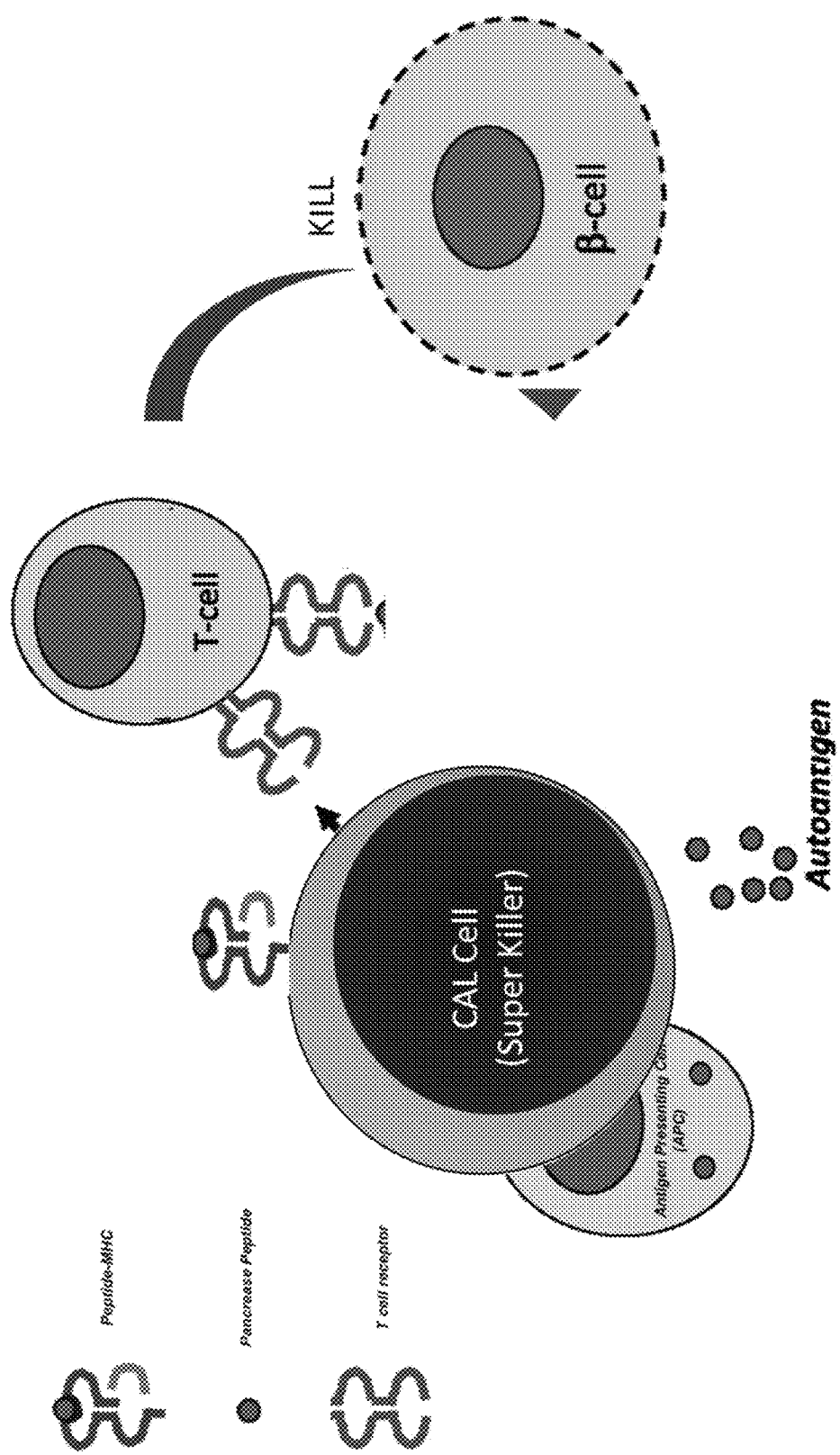
FIG. 25 depicts a schematic of the CAL technology disarming autoreactive T cells.

Experimental design is shown in FIG. 17. Human CD8 pMHC-CAR T killing is highly specific and MHC-CAR T cell does not kill bystander CD4 T cells (FIG. 18). No cytotoxicity effect was seen on human CD8 pMHC-CART (FIG. 19). Cytotoxicity against CART cells was long-lived (FIG. 20) and levels of CD69 on OTi CD8 T cells was followed (FIG. 21).

This experiment demonstrated activation of target cells with no significant cytotoxicity on the killer cells. It is possible that Killer Cells activation might be suboptimal under these conditions and use of primary T cells could include fresh, syngeneic cells for improved activation.

Example 10

Figure 29:
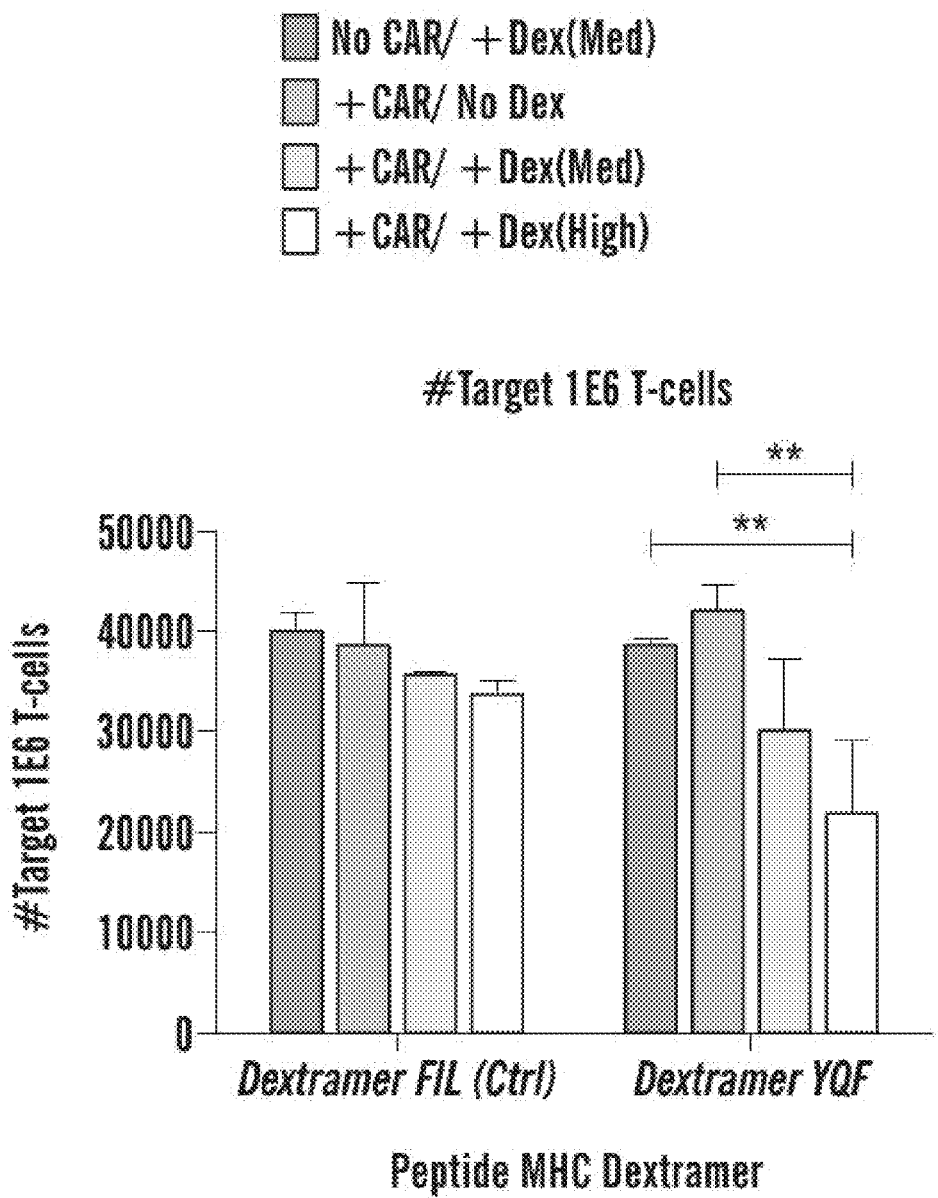
FIG. 29 depicts a graph demonstrating that cytotoxicity of pMHC-CAR against 1E6 T cell clone exhibits a dose dependent association.

1E6 T cell clone is a well-established CD8+ specific for the major β-cell autoantigen, preproinsulin (PPI). The 1E6 clone mediates β-cell-specific killing via recognition of a highly distinctive HLA A*0201-presented signal peptide epitope (PPI15-24) that exhibits glucose-dependent presentation on the surface of human β-cells (9). The inventors generated and tested a split pMHC-CAR that targets 1E6 T-cells through A*0201+peptides. Effective killing of 1E6 T-cells was observed (FIG. 29)

Example 11

Figures 26A, 26B:
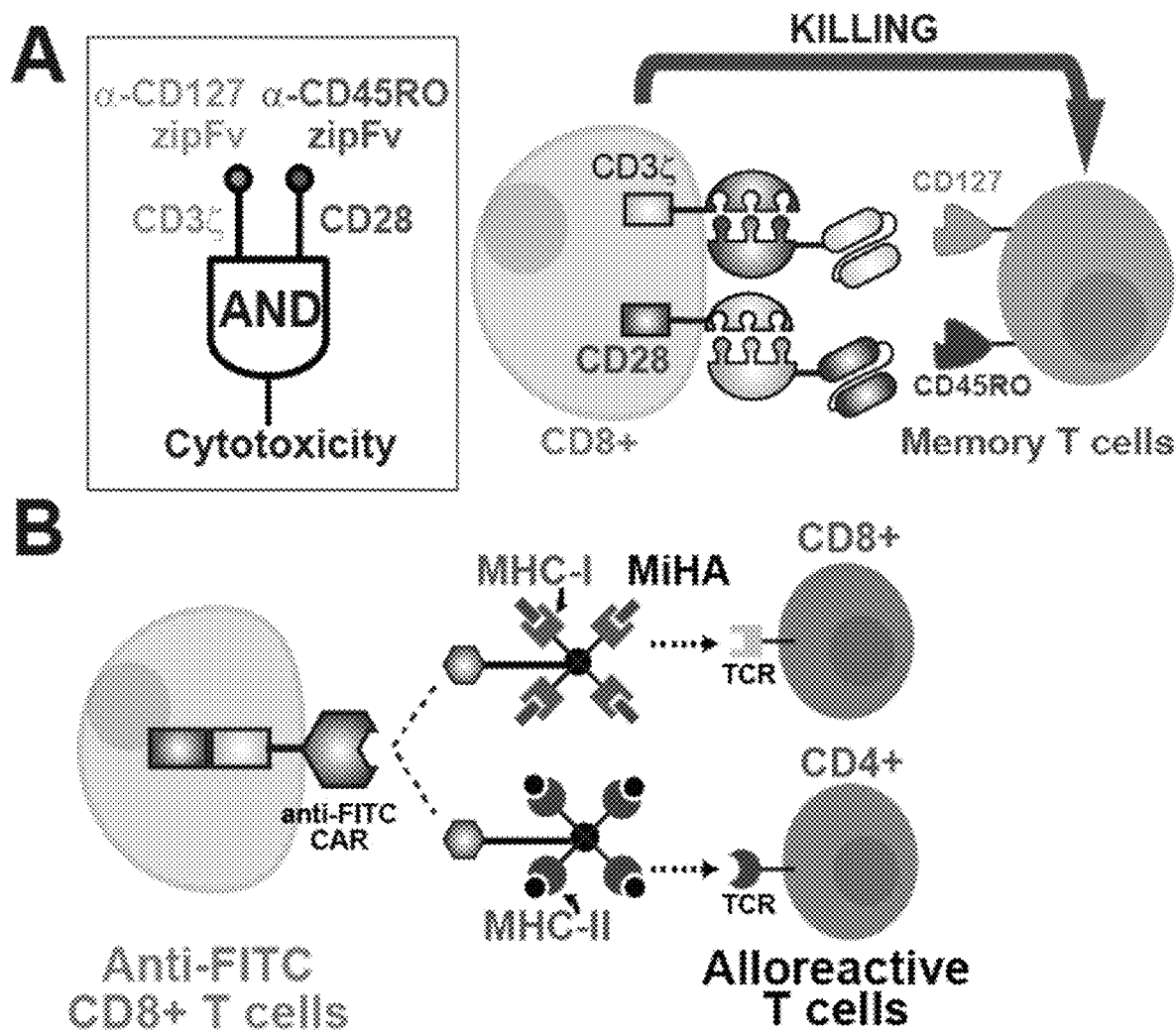
FIGS. 26A-26B depict schematics of T cells design. MHC can be mouse or human. The MiHA can be ovalbumin (against OTi or OTii) or disparate antigens between donor and recipient.
Figure 27:
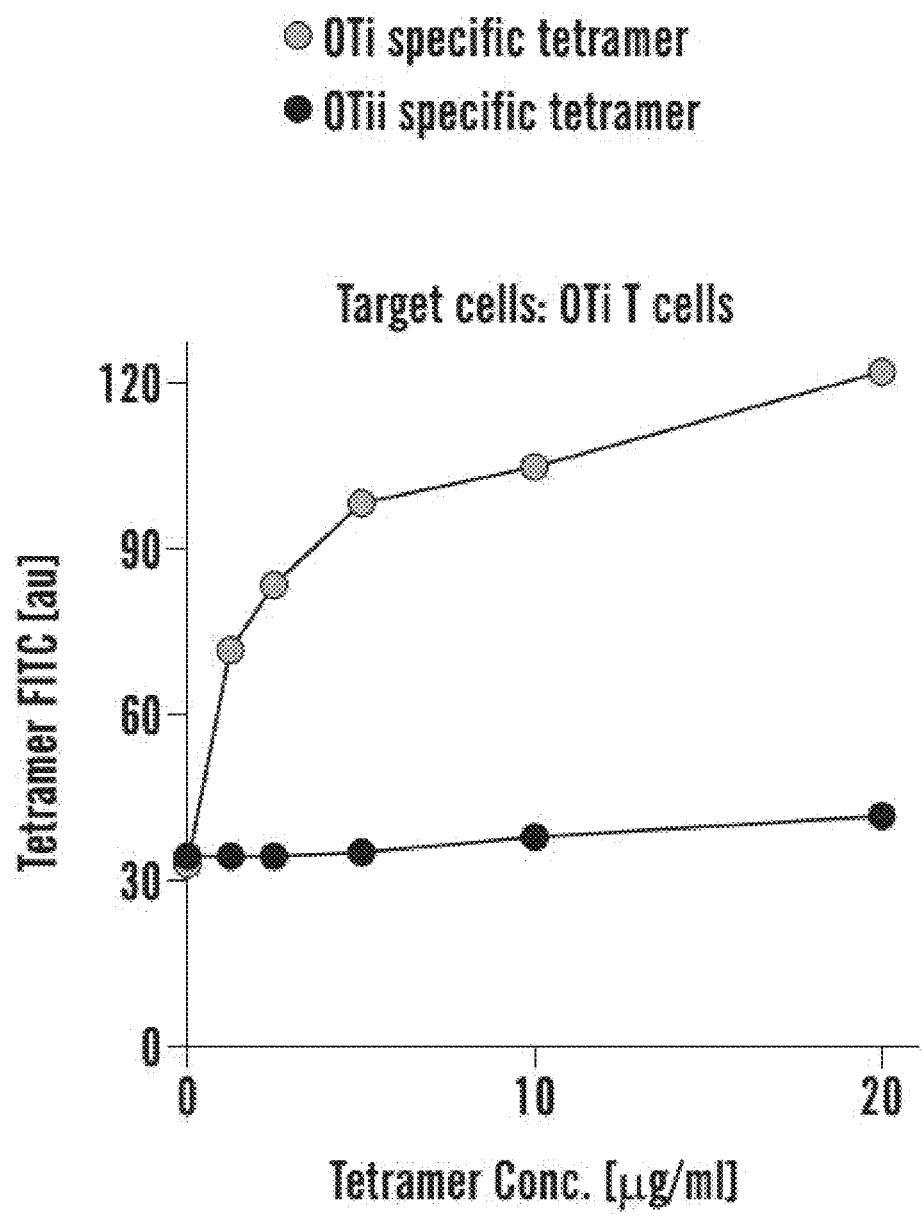
FIG. 27 depicts a graph demonstrating that pMHC tetramer+FITC (adaptor) binds to the target cells (OTi) in a dose dependent fashion, while OTii specific tetramer does not.
Figures 28A, 28B:
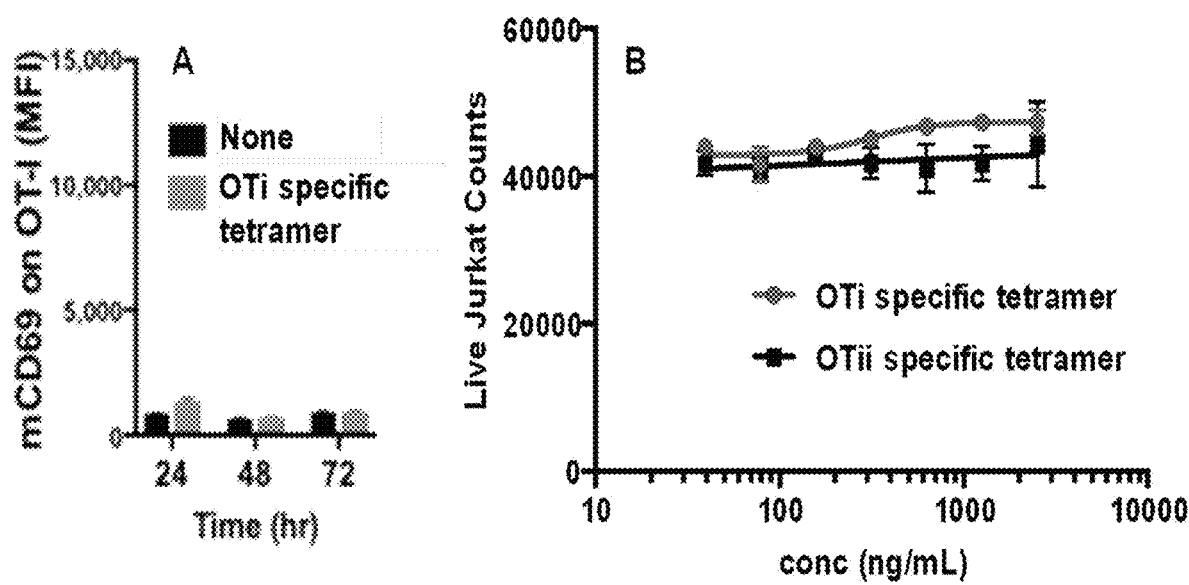
FIG. 28A depicts expression of CD69 on OTi cells at different time points (24, 48, 72 hrs.).
FIG. 28B is a graph demonstrating that binding of Jurkat+ pMHC to OTi cells does not change Jurkat live count.
Figure 30:
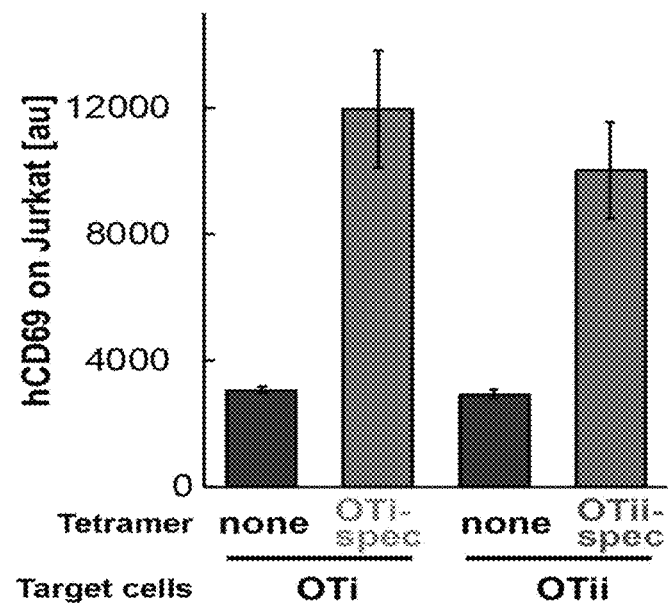
FIG. 30 depicts a graph demonstrating that CAR Jurkat T cells activation (as measured by CD69 surface marker) after exposure to target cells (OTi or OTii TCR expressing T cells) and the corresponding tetramer (OTi or OTii specific) (n=4).
Figure 31:
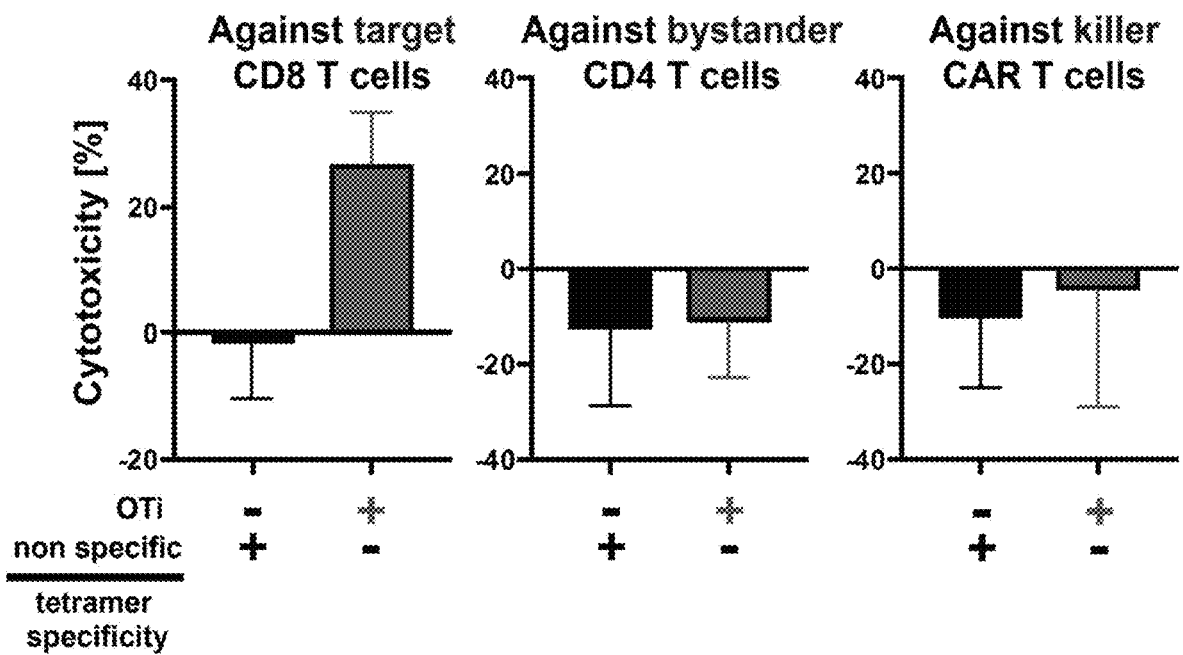
FIG. 31 depicts graphs demonstrating that cytotoxicity of human CD8 CART is highly specific and was not seen with ctrl tetramer. No cytotoxicity was seen on killer CAR T cells or bystander CD4 T Cells after co-culturing with pMHC and splenocytes (n=4).
Figure 32:
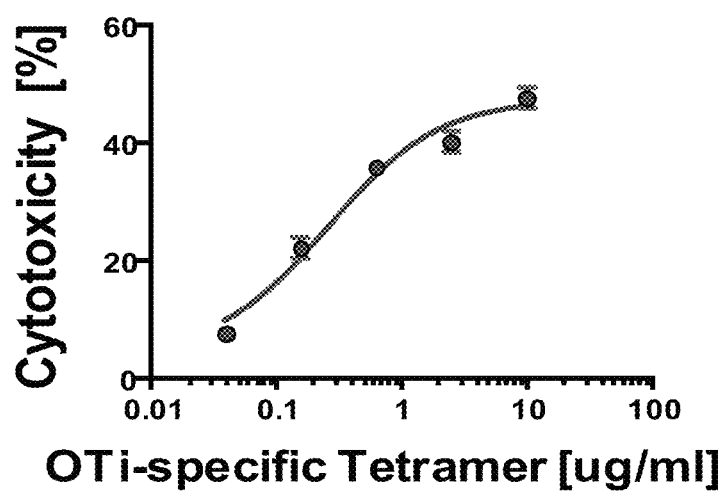
FIG. 32 depicts a graph demonstrating cytotoxicity of Primary CD8 CAR T cells against OTi TCR T cells with different concentration of tetramer.

CALs comprising ovalbumin MiHA (against OTi or OTii) were constructed (FIG. 26). pMHC tetramer+FITC (adaptor) binds to the target cells (OTi) in a dose dependent fashion, while OTii specific tetramer does not (FIG. 27). Binding of Jurkat+pMHC to OTi cells does not change Jurkat live count (FIGS. 28B and 30). However, human CD8 CAR T were cytotoxic with high specificity (FIGS. 31 and 32). Cytotoxicity was not seen with ctrl tetramer. No cytotoxicity was seen on killer CAR T cells or bystander CD4 T Cells after co-culturing with pMHC and splenocytes.

SEQUENCE LISTING (2757 sequences)

SEQ ID NO: 1 - protein, 459 aa, Homo sapiens
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGEMDPILLTISILSFFSVALLVILACVLWKKRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 2 - protein, 87 aa, Homo sapiens
MTMYLWLKLLAFGFAFLDTEVFVTGQSPTPSPTGHLQAEEQGSQSKSPNLKSREADSSAFSWWPKAREPLTNHWSKSKSPKAEELGV

SEQ ID NO: 3 - protein, 51 aa, Artificial Sequence
  Description of Artificial Sequence: Synthetic polypeptide
MDPDLEIRAAFLRQRNTALRTEVAELEQEVQRLENEVSQYETRYGPLGGGK

SEQ ID NO: 4 - protein, 51 aa, Artificial Sequence
  Description of Artificial Sequence: Synthetic polypeptide
MDPDLEIEAAFLERENTALETRVAELRQRVQRLRNRVSQYRTRYGPLGGGK

SEQ ID NO: 5 - protein, 335 aa, Homo sapiens
MGCLLFLLLWALLQAWGSAEVPQRLFPLRCLQISSFANSSWTRTDGLAWLGELQTHSWSNDSDTVRSLKPWSQGTFSDQQWETLQHIFRVYRSSFTRDVKEFAKMLRLSYPLELQVSAGCEVHPGNASNNFFHVAFQGKDILSFQGTSWEPTQEAPLWVNLAIQVLNQDKWTRETVQWLLNGTCPQFVSGLLESGKSELKKQVKPKAWLSRGPSPGPGRLLLVCHVSGFYPKPVWVKWMRGEQEQQGTQPGDILPNADETWYLRATLDVVAGEAAGLSCRVKHSSLEGQDIVLYWGGSYTSMGLIALAVLACLLFLLIVGFTSRFKRQTSYQGVL

SEQ ID NO: 6 - protein, 242 aa, Homo sapiens
MGCLLFLLLWALLQAWGSAEVPQRLFPLRCLQISSFANSSWTRTDGLAWLGELQTHSWSNDSDTVRSLKPWSQGTFSDQQWETLQHIFRVYRSSFTRDVKEFAKMLRLSYPLELQVSAGCEVHPGNASNNFFHVAFQGKDILSFQGTSWEPTQEAPLWVNLAIQVLNQDKWTRETVQWLLNGTCPQFVSGLLESGKSELKKQGGSYTSMGLIALAVLACLLFLLIVGFTSRFKRQTSYQGVL

SEQ ID NO: 7 - protein, 231 aa, Homo sapiens
MLRLSYPLELQVSAGCEVHPGNASNNFFHVAFQGKDILSFQGTSWEPTQEAPLWVNLAIQVLNQDKWTRETVQWLLNGTCPQFVSGLLESGKSELKKQVKPKAWLSRGPSPGPGRLLLVCHVSGFYPKPVWVKWMRGEQEQQGTQPGDILPNADETWYLRATLDVVAGEAAGLSCRVKHSSLEGQDIVLYWGGSYTSMGLIALAVLACLLFLLIVGFTSRFKRQTSYQGVL

SEQ ID NO: 8 - protein, 365 aa, Homo sapiens [sequence omitted]

SEQ ID NO: 9 - protein, 119 aa, Homo sapiens [sequence omitted]

SEQ ID NO: 10 - protein, 10 aa, Homo sapiens
ALWGPDPAAA

SEQ ID NO: 11 - protein, 10 aa, Artificial Sequence
  Description of Artificial Sequence: Synthetic peptide
AQWGPDPAAA

SEQ ID NO: 12 - protein, 10 aa, Artificial Sequence
  Description of Artificial Sequence: Synthetic peptide
RQWGPDPAAV

SEQ ID NO: 13 - protein, 10 aa, Clostridium asparagiforme
RQFGPDWIVA

SEQ ID NO: 14 - protein, 10 aa, Artificial Sequence
  Description of Artificial Sequence: Synthetic peptide
YQFGPDFPIA

SEQ ID NO: 15 - protein, 10 aa, Artificial Sequence
  Description of Artificial Sequence: Synthetic peptide
RQFGPDFPTI

SEQ ID NO: 16 - protein, 10 aa, Artificial Sequence
  Description of Artificial Sequence: Synthetic peptide
YLGGPDFPTI

SEQ ID NO: 17 - protein, 9 aa, Bacteroides fragilis
MVWGPDLYV

SEQ ID NO: 18 - protein, 365 aa, Homo sapiens [sequence omitted]

SEQ ID NO: 19 - protein, 119 aa, Homo sapiens [sequence omitted]

SEQ ID NO: 20 - protein, 10 aa, Homo sapiens
ELAGIGILTV

SEQ ID NO: 21 - protein, 9 aa, Homo sapiens
YMDGTMSQV

SEQ ID NO: 22 - protein, 9 aa, Homo sapiens
ITDQVPFSV

SEQ ID NO: 23-999 - skipped (977 entries)

SEQ ID NO: 1000 - protein, 22 aa, Artificial Sequence
  Description of Artificial Sequence: Synthetic peptide
VPVPQLQPQNPSQQQPQEQVPL

SEQ ID NO: 1001 - protein, 31 aa, Artificial Sequence
  Description of Artificial Sequence: Synthetic polypeptide
VQQQQFPGQQQPFPPQQPYPQPQPFPSQQPY

SEQ ID NO: 1002 - protein, 19 aa, Artificial Sequence
  Description of Artificial Sequence: Synthetic peptide
VRVPVPQLQPQNPSQQQPQ

SEQ ID NO: 1003 - protein, 18 aa, Artificial Sequence
  Description of Artificial Sequence: Synthetic peptide
QNPSQQQPQEQVPLVQQQ

SEQ ID NO: 1004 - protein, 20 aa, Artificial Sequence
  Description of Artificial Sequence: Synthetic peptide
FPGQQQPFPPQQPYPQPQPF

SEQ ID NO: 1005 - protein, 12 aa, Artificial Sequence
  Description of Artificial Sequence: Synthetic peptide
PQPQPFPSQQPY

SEQ ID NO: 1006 - protein, 20 aa, Artificial Sequence
  Description of Artificial Sequence: Synthetic peptide
YLQLQPFPQPQLPYPQPQLP

SEQ ID NO: 1007 - protein, 15 aa, Artificial Sequence
  Description of Artificial Sequence: Synthetic peptide
YLQLQPFPQPQLPYP

SEQ ID NO: 1008 - protein, 33 aa, Artificial Sequence
  Description of Artificial Sequence: Synthetic polypeptide
LQLQPFPQPQLPYPQPQLPYPQPQLPYPQPQPF

SEQ ID NO: 1009 - protein, 33 aa, Artificial Sequence
  Description of Artificial Sequence: Synthetic polypeptide
LQLQPFPQPELPYPQPELPYPQPELPYPQPQPF

SEQ ID NO: 1010 - protein, 20 aa, Artificial Sequence
  Description of Artificial Sequence: Synthetic peptide
LQLQPFPQPQLPYPQPQLPY

SEQ ID NO: 1011 - protein, 20 aa, Artificial Sequence
  Description of Artificial Sequence: Synthetic peptide
LQLQPFPQPELPYPQPQLPY

SEQ ID NO: 1012 - protein, 13 aa, Artificial Sequence
  Description of Artificial Sequence: Synthetic peptide
LQLQPFPQPQLPY

SEQ ID NO: 1013 - protein, 13 aa, Artificial Sequence
  Description of Artificial Sequence: Synthetic peptide
LQLQPFPQPELPY

SEQ ID NO: 1014 - protein, 16 aa, Artificial Sequence
  Description of Artificial Sequence: Synthetic peptide
QLQPFPQPQLPYPQPQ

SEQ ID NO: 1015 - protein, 15 aa, Artificial Sequence
  Description of Artificial Sequence: Synthetic peptide
QLQPFPQPQLPYPQP

SEQ ID NO: 1016 - protein, 15 aa, Artificial Sequence
  Description of Artificial Sequence: Synthetic peptide
QLQPFPQPQLPYTHP

SEQ ID NO: 1017 - protein, 15 aa, Artificial Sequence
  Description of Artificial Sequence: Synthetic peptide
QLRPFPQPQLPYPQP

SEQ ID NO: 1018 - protein, 15 aa, Artificial Sequence
  Description of Artificial Sequence: Synthetic peptide
QLQPFPHPQLPYPHP

SEQ ID NO: 1019 - protein, 15 aa, Artificial Sequence
  Description of Artificial Sequence: Synthetic peptide
QLQPFPQAQLPYPQP

SEQ ID NO: 1020 - protein, 14 aa, Artificial Sequence
  Description of Artificial Sequence: Synthetic peptide
QLQPFPQPQLPYPQ

SEQ ID NO: 1021 - protein, 14 aa, Artificial Sequence
  Description of Artificial Sequence: Synthetic peptide
QLQPFPQPELPYPQ

SEQ ID NO: 1022 - protein, 12 aa, Artificial Sequence
  Description of Artificial Sequence: Synthetic peptide
QLQPFPQPQLPY

SEQ ID NO: 1023 - protein, 12 aa, Artificial Sequence
  Description of Artificial Sequence: Synthetic peptide
QLQPFPQPELPY

SEQ ID NO: 1024 - protein, 12 aa, Artificial Sequence
  Description of Artificial Sequence: Synthetic peptide
QLQPFPEPQLPY

SEQ ID NO: 1025 - protein, 12 aa, Artificial Sequence
  Description of Artificial Sequence: Synthetic peptide
QLQPFPEPELPY

SEQ ID NO: 1026 - protein, 12 aa, Artificial Sequence
  Description of Artificial Sequence: Synthetic peptide
QLQPFPQQQLPY

SEQ ID NO: 1027 - protein, 12 aa, Artificial Sequence
  Description of Artificial Sequence: Synthetic peptide
QLQPFPEQQLPY

SEQ ID NO: 1028 - protein, 12 aa, Artificial Sequence
  Description of Artificial Sequence: Synthetic peptide
QLQPFPQQELPY

SEQ ID NO: 1029 - protein, 12 aa, Artificial Sequence
  Description of Artificial Sequence: Synthetic peptide
QLQPFPEQELPY

SEQ ID NO: 1030 - protein, 15 aa, Artificial Sequence
  Description of Artificial Sequence: Synthetic peptide
LQPFPQPQLPYPQPQ

SEQ ID NO: 1031 - protein, 15 aa, Artificial Sequence
  Description of Artificial Sequence: Synthetic peptide
LQPFPQPELPYPQPQ

SEQ ID NO: 1032 - protein, 15 aa, Artificial Sequence
  Description of Artificial Sequence: Synthetic peptide
LQPFPQSQLPYPQPQ

SEQ ID NO: 1033 - protein, 15 aa, Artificial Sequence
  Description of Artificial Sequence: Synthetic peptide
LQPFPQSELPYPQPQ

SEQ ID NO: 1034 - protein, 11 aa, Artificial Sequence
  Description of Artificial Sequence: Synthetic peptide
LQPFPQPQLPY

SEQ ID NO: 1035 - protein, 11 aa, Artificial Sequence
  Description of Artificial Sequence: Synthetic peptide
LQPFPQPELPY

SEQ ID NO: 1036 - protein, 17 aa, Artificial Sequence
  Description of Artificial Sequence: Synthetic peptide
QPFPQPQLPYPQPQLPY

SEQ ID NO: 1037 - protein, 17 aa, Artificial Sequence
  Description of Artificial Sequence: Synthetic peptide
QPFPQPELPYPQPQLPY

SEQ ID NO: 1038 - protein, 17 aa, Artificial Sequence
  Description of Artificial Sequence: Synthetic peptide
QPFPQPQLPYPQPELPY

SEQ ID NO: 1039 - protein, 17 aa, Artificial Sequence
  Description of Artificial Sequence: Synthetic peptide
QPFPQPELPYPQPELPY

SEQ ID NO: 1040 - protein, 10 aa, Artificial Sequence
  Description of Artificial Sequence: Synthetic peptide
QPFPQPQLPY

SEQ ID NO: 1041 - protein, 10 aa, Artificial Sequence
  Description of Artificial Sequence: Synthetic peptide
QPFPQPELPY

SEQ ID NO: 1042 - protein, 15 aa, Artificial Sequence
  Description of Artificial Sequence: Synthetic peptide
PFPQPQLPYPQPQLP

SEQ ID NO: 1043 - protein, 11 aa, Artificial Sequence
  Description of Artificial Sequence: Synthetic peptide
PFPQPQLPYPQ

SEQ ID NO: 1044 - protein, 11 aa, Artificial Sequence
  Description of Artificial Sequence: Synthetic peptide
PFPQPELPYPQ

SEQ ID NO: 1045 - protein, 11 aa, Artificial Sequence
  Description of Artificial Sequence: Synthetic peptide
PFPQPQLPYTH

SEQ ID NO: 1046 - protein, 11 aa, Artificial Sequence
  Description of Artificial Sequence: Synthetic peptide
PFPQPELPYTH

SEQ ID NO: 1047 - protein, 11 aa, Artificial Sequence
  Description of Artificial Sequence: Synthetic peptide
PFPHPQLPYPQ

SEQ ID NO: 1048 - protein, 11 aa, Artificial Sequence
  Description of Artificial Sequence: Synthetic peptide
PFPHPELPYPQ

SEQ ID NO: 1049 - protein, 9 aa, Artificial Sequence
  Description of Artificial Sequence: Synthetic peptide
PFPQPQLPY

SEQ ID NO: 1050 - protein, 9 aa, Artificial Sequence
  Description of Artificial Sequence: Synthetic peptide
PFPQPELPY

SEQ ID NO: 1051 - protein, 14 aa, Artificial Sequence
  Description of Artificial Sequence: Synthetic peptide
PQPQLPYPQPQLPY

SEQ ID NO: 1052 - protein, 14 aa, Artificial Sequence
  Description of Artificial Sequence: Synthetic peptide
PQPQLPYPQPELPY

SEQ ID NO: 1053 - protein, 14 aa, Artificial Sequence
  Description of Artificial Sequence: Synthetic peptide
PQPELPYPQPQLPY

SEQ ID NO: 1054 - protein, 14 aa, Artificial Sequence
  Description of Artificial Sequence: Synthetic peptide
PQPELPYPQPELPY

SEQ ID NO: 1055 - protein, 14 aa, Artificial Sequence
  Description of Artificial Sequence: Synthetic peptide
PQPELPYPAPQLPY

SEQ ID NO: 1056 - protein, 14 aa, Artificial Sequence
  Description of Artificial Sequence: Synthetic peptide
PQPELPYPQPALPY

SEQ ID NO: 1057 - protein, 14 aa, Artificial Sequence
  Description of Artificial Sequence: Synthetic peptide
PQPELPYPQPQAPY

SEQ ID NO: 1058 - protein, 14 aa, Artificial Sequence
  Description of Artificial Sequence: Synthetic peptide
PQPELPYPQPQLAY

SEQ ID NO: 1059 - protein, 14 aa, Artificial Sequence
  Description of Artificial Sequence: Synthetic peptide
PQPELPYPQPQLPA

SEQ ID NO: 1060 - protein, 12 aa, Artificial Sequence
  Description of Artificial Sequence: Synthetic peptide
PQPQLPYPQPQL

SEQ ID NO: 1061 - protein, 12 aa, Artificial Sequence
  Description of Artificial Sequence: Synthetic peptide
PQPELPYPQPQL

SEQ ID NO: 1062 - protein, 11 aa, Artificial Sequence
  Description of Artificial Sequence: Synthetic peptide
PQPQLPYPQPQ

SEQ ID NO: 1063 - protein, 11 aa, Artificial Sequence
  Description of Artificial Sequence: Synthetic peptide
PQPELPYPQPE

SEQ ID NO: 1064 - protein, 9 aa, Artificial Sequence
  Description of Artificial Sequence: Synthetic peptide
PQPQLPYPQ

SEQ ID NO: 1065 - protein, 9 aa, Artificial Sequence
  Description of Artificial Sequence: Synthetic peptide
PQPELPYPQ

SEQ ID NO: 1066 - protein, 15 aa, Artificial Sequence
  Description of Artificial Sequence: Synthetic peptide
QPQLPYPQPQLPYPQ

SEQ ID NO: 1067 - protein, 20 aa, Artificial Sequence
  Description of Artificial Sequence: Synthetic peptide
PQLPYPQPQLPYPQPQLPYP

SEQ ID NO: 1068 - protein, 12 aa, Artificial Sequence
  Description of Artificial Sequence: Synthetic peptide
PQLPYPQPQLPY

SEQ ID NO: 1069 - protein, 12 aa, Artificial Sequence
  Description of Artificial Sequence: Synthetic peptide
PQLPYPQPELPY

SEQ ID NO: 1070 - protein, 12 aa, Artificial Sequence
  Description of Artificial Sequence: Synthetic peptide
LQLPFPQPQLPY

SEQ ID NO: 1071 - protein, 12 aa, Artificial Sequence
  Description of Artificial Sequence: Synthetic peptide
LQLPFPQPELPY

SEQ ID NO: 1072 - protein, 25 aa, Artificial Sequence
  Description of Artificial Sequence: Synthetic peptide
PQLPQFLQPQPYPQPQLPYPQPQPF

SEQ ID NO: 1073 - protein, 25 aa, Artificial Sequence
  Description of Artificial Sequence: Synthetic peptide
PELPQFLQPQPYPQPQLPYPQPQPF

SEQ ID NO: 1074 - protein, 25 aa, Artificial Sequence
  Description of Artificial Sequence: Synthetic peptide
PQLPQFLQPQPYPQPELPYPQPQPF

SEQ ID NO: 1075 - protein, 25 aa, Artificial Sequence
  Description of Artificial Sequence: Synthetic peptide
PELPQFLQPQPYPQPELPYPQPQPF

SEQ ID NO: 1076 - protein, 15 aa, Artificial Sequence
  Description of Artificial Sequence: Synthetic peptide
QLPYPQPQLPYPQPQ

SEQ ID NO: 1077 - protein, 13 aa, Artificial Sequence
  Description of Artificial Sequence: Synthetic peptide
QLPYPQPQLPYPQ

SEQ ID NO: 1078 - protein, 13 aa, Artificial Sequence
  Description of Artificial Sequence: Synthetic peptide
QLPYPQPELPYPQ

SEQ ID NO: 1079 - protein, 12 aa, Artificial Sequence
  Description of Artificial Sequence: Synthetic peptide
LPYPQPQLPYPQ

SEQ ID NO: 1080 - protein, 9 aa, Artificial Sequence
  Description of Artificial Sequence: Synthetic peptide
PYPQPQLPY

SEQ ID NO: 1081 - protein, 9 aa, Artificial Sequence
  Description of Artificial Sequence: Synthetic peptide
PYPQPELPY

SEQ ID NO: 1082 - protein, 18 aa, Artificial Sequence
  Description of Artificial Sequence: Synthetic peptide
QPQPYPQPQLPYPQPQPF

SEQ ID NO: 1083 - protein, 18 aa, Artificial Sequence
  Description of Artificial Sequence: Synthetic peptide
QPQPYPQPELPYPQPQPF

SEQ ID NO: 1084 - protein, 20 aa, Artificial Sequence
  Description of Artificial Sequence: Synthetic peptide
PQLPYPQPQLPYPQPQPFRP

SEQ ID NO: 1085 - protein, 20 aa, Artificial Sequence
  Description of Artificial Sequence: Synthetic peptide
PQLPYPQPELPYPQPQPFRP

SEQ ID NO: 1086 - protein, 16 aa, Artificial Sequence
  Description of Artificial Sequence: Synthetic peptide
YPQPQLPYPQPQPFRP

SEQ ID NO: 1087 - protein, 16 aa, Artificial Sequence
  Description of Artificial Sequence: Synthetic peptide
YPQPELPYPQPQPFRP

SEQ ID NO: 1088 - protein, 15 aa, Artificial Sequence
  Description of Artificial Sequence: Synthetic peptide
YPQPQLPYPQPQPFR

SEQ ID NO: 1089 - protein, 9 aa, Artificial Sequence
  Description of Artificial Sequence: Synthetic peptide
FRPQQPYPQ

SEQ ID NO: 1090 - protein, 9 aa, Artificial Sequence
  Description of Artificial Sequence: Synthetic peptide
FRPEQPYPQ

SEQ ID NO: 1091 - protein, 25 aa, Artificial Sequence
  Description of Artificial Sequence: Synthetic peptide
QQPQQQYPSGQGSFQPSQQNPQAQG

SEQ ID NO: 1092 - protein, 24 aa, Artificial Sequence
  Description of Artificial Sequence: Synthetic peptide
QQPQQQYPSGQGSFQPSQQNPQAQ

SEQ ID NO: 1093 - protein, 24 aa, Artificial Sequence
  Description of Artificial Sequence: Synthetic peptide
QQPQQQYPSGEGSFQPSQENPQAQ

SEQ ID NO: 1094 - protein, 24 aa, Artificial Sequence
  Description of Artificial Sequence: Synthetic peptide
QQPQQQYPSGEGSFQPSQQNPQAQ

SEQ ID NO: 1095 - protein, 24 aa, Artificial Sequence
  Description of Artificial Sequence: Synthetic peptide
QQPQQQYPSGQGSFQPSQENPQAQ

SEQ ID NO: 1096 - protein, 20 aa, Artificial Sequence
  Description of Artificial Sequence: Synthetic peptide
QPQQQYPSGQGSFQPSQQNP

SEQ ID NO: 1097 - protein, 18 aa, Artificial Sequence
  Description of Artificial Sequence: Synthetic peptide
QQYPSGQGSFQPSQQNPQ

SEQ ID NO: 1098 - protein, 18 aa, Artificial Sequence
  Description of Artificial Sequence: Synthetic peptide
QYPSGQGSFQPSQQNPQA

SEQ ID NO: 1099 - protein, 18 aa, Artificial Sequence
  Description of Artificial Sequence: Synthetic peptide
QYPSGEGSFQPSQENPQA

SEQ ID NO: 1100 - protein, 15 aa, Artificial Sequence
  Description of Artificial Sequence: Synthetic peptide
YPSGQGSFQPSQQNP

SEQ ID NO: 1101 - protein, 18 aa, Artificial Sequence
  Description of Artificial Sequence: Synthetic peptide
PSGQGSFQPSQQNPQAQG

SEQ ID NO: 1102 - protein, 12 aa, Artificial Sequence
  Description of Artificial Sequence: Synthetic peptide
PSGQGSFQPSQQ

SEQ ID NO: 1103 - protein, 11 aa, Artificial Sequence
  Description of Artificial Sequence: Synthetic peptide
PSGQGSFQPSQ

SEQ ID NO: 1104 - protein, 12 aa, Artificial Sequence
  Description of Artificial Sequence: Synthetic peptide
SGQGSFQPSQQN

SEQ ID NO: 1105 - protein, 12 aa, Artificial Sequence
  Description of Artificial Sequence: Synthetic peptide
SGQGSFQPSEQN

SEQ ID NO: 1106 - protein, 12 aa, Artificial Sequence
  Description of Artificial Sequence: Synthetic peptide
SGEGSFQPSQQN

SEQ ID NO: 1107 - protein, 12 aa, Artificial Sequence
  Description of Artificial Sequence: Synthetic peptide
SGQGSFQPSQEN

SEQ ID NO: 1108 - protein, 12 aa, Artificial Sequence
  Description of Artificial Sequence: Synthetic peptide
SGEGSFQPSQEN

SEQ ID NO: 1109 - protein, 9 aa, Artificial Sequence
  Description of Artificial Sequence: Synthetic peptide
GQGSFQPSQ

SEQ ID NO: 1110 - protein, 9 aa, Artificial Sequence
  Description of Artificial Sequence: Synthetic peptide
QGSFQPSQQ

SEQ ID NO: 1111 - protein, 9 aa, Artificial Sequence
  Description of Artificial Sequence: Synthetic peptide
EGSFQPSQQ

SEQ ID NO: 1112 - protein, 9 aa, Artificial Sequence
  Description of Artificial Sequence: Synthetic peptide
QGSFQPSQE

SEQ ID NO: 1113 - protein, 9 aa, Artificial Sequence
  Description of Artificial Sequence: Synthetic peptide
EGSFQPSQE

SEQ ID NO: 1114 - protein, 15 aa, Artificial Sequence
  Description of Artificial Sequence: Synthetic peptide
GSFQPSQQNPQAQGS

SEQ ID NO: 1115 - protein, 15 aa, Artificial Sequence
  Description of Artificial Sequence: Synthetic peptide
QAQGSVQPQQLPQFE

SEQ ID NO: 1116 - protein, 20 aa, Artificial Sequence
  Description of Artificial Sequence: Synthetic peptide
MQLQPFPQPQLPYPQPQLPY

SEQ ID NO: 1117 - protein, 20 aa, Artificial Sequence
  Description of Artificial Sequence: Synthetic peptide
MQLQPFPQPELPYPQPQLPY

SEQ ID NO: 1118 - protein, 16 aa, Artificial Sequence
  Description of Artificial Sequence: Synthetic peptide
QLQPFPQPELPYPQPQ

SEQ ID NO: 1119 - protein, 16 aa, Artificial Sequence
  Description of Artificial Sequence: Synthetic peptide
ELQPFPQPELPYPQPQ

SEQ ID NO: 1120 - protein, 12 aa, Artificial Sequence
  Description of Artificial Sequence: Synthetic peptide
QPFPQPQLPYPQ

SEQ ID NO: 1121 - protein, 12 aa, Artificial Sequence
  Description of Artificial Sequence: Synthetic peptide
QPFPQPELPYPQ

SEQ ID NO: 1122 - protein, 20 aa, Artificial Sequence
  Description of Artificial Sequence: Synthetic peptide
PQPFPPQLPYPQPQLPYPQP

SEQ ID NO: 1123 - protein, 20 aa, Artificial Sequence
  Description of Artificial Sequence: Synthetic peptide
PQPFPPQLPYPQPELPYPQP

SEQ ID NO: 1124 - protein, 12 aa, Artificial Sequence
  Description of Artificial Sequence: Synthetic peptide
LPYPQPELPYPQ

SEQ ID NO: 1125 - protein, 20 aa, Artificial Sequence
  Description of Artificial Sequence: Synthetic peptide
VAHAIIMHQQQQQQQEQKQQ

SEQ ID NO: 1126 - protein, 16 aa, Artificial Sequence
  Description of Artificial Sequence: Synthetic peptide
VAHAIIMHQQQQQQQE

SEQ ID NO: 1127 - protein, 19 aa, Artificial Sequence
  Description of Artificial Sequence: Synthetic peptide
AGQQQPFPPQQPYPQPQPF

SEQ ID NO: 1128 - protein, 19 aa, Artificial Sequence
  Description of Artificial Sequence: Synthetic peptide
LGQQQAFPPQQPYPQPQPF

SEQ ID NO: 1129 - protein, 16 aa, Artificial Sequence
  Description of Artificial Sequence: Synthetic peptide
PQPFRPQQPYPQPQPQ

SEQ ID NO: 1130 - protein, 16 aa, Artificial Sequence
  Description of Artificial Sequence: Synthetic peptide
PQPFRPEQPYPQPQPQ

SEQ ID NO: 1131 - protein, 14 aa, Artificial Sequence
  Description of Artificial Sequence: Synthetic peptide
PFRPQQPYPQPQPQ

SEQ ID NO: 1132 - protein, 14 aa, Artificial Sequence
  Description of Artificial Sequence: Synthetic peptide
PFRPEQPYPQPQPQ

SEQ ID NO: 1133 - protein, 11 aa, Artificial Sequence
  Description of Artificial Sequence: Synthetic peptide
PQQPYPQPQPQ

SEQ ID NO: 1134 - protein, 11 aa, Artificial Sequence
  Description of Artificial Sequence: Synthetic peptide
PEQPYPQPQPQ

SEQ ID NO: 1135 - protein, 10 aa, Artificial Sequence
  Description of Artificial Sequence: Synthetic peptide
QLIPCMDVVL

SEQ ID NO: 1136 - protein, 12 aa, Artificial Sequence
  Description of Artificial Sequence: Synthetic peptide
LGQGSFRPSQQN

SEQ ID NO: 1137 - protein, 55 aa, Artificial Sequence
  Description of Artificial Sequence: Synthetic polypeptide
VRVPVPQLQPQNPSQQQPQEQVPLVQQQQFLGQQQPFPPQQPYPQPQPFPSQQPY

SEQ ID NO: 1138 - protein, 30 aa, Artificial Sequence
  Description of Artificial Sequence: Synthetic polypeptide
VRVPVPQLQPQNPSQQQPQEQVPLVQQQQF

SEQ ID NO: 1139 - protein, 53 aa, Artificial Sequence
  Description of Artificial Sequence: Synthetic polypeptide
VPVPQLQPQNPSQQQPQEQVPLVQQQQFGGQQQPFPPQQPYPQPQPFPSQQPY

SEQ ID NO: 1140 - protein, 20 aa, Artificial Sequence
  Description of Artificial Sequence: Synthetic peptide
QVPLVQQQQFLGQQQPFPPQ

SEQ ID NO: 1141 - protein, 19 aa, Artificial Sequence
  Description of Artificial Sequence: Synthetic peptide
QFLGQQQPFPPQQPYPQPQ

SEQ ID NO: 1142 - protein, 18 aa, Artificial Sequence
  Description of Artificial Sequence: Synthetic peptide
FLGQQQPFPPQQPYPQPQ

SEQ ID NO: 1143 - protein, 25 aa, Artificial Sequence
  Description of Artificial Sequence: Synthetic peptide
LGQQQPFPPQQPYPQPQPFPSQQPY

SEQ ID NO: 1144 - protein, 19 aa, Artificial Sequence
  Description of Artificial Sequence: Synthetic peptide
LGQQQPFPPQQPYPQPQPF

SEQ ID NO: 1145 - protein, 17 aa, Artificial Sequence
  Description of Artificial Sequence: Synthetic peptide
LGQQQPFPPQQPYPQPQ

SEQ ID NO: 1146 - protein, 13 aa, Artificial Sequence
  Description of Artificial Sequence: Synthetic peptide
LGQQQPFPPQQPY

SEQ ID NO: 1147 - protein, 20 aa, Artificial Sequence
  Description of Artificial Sequence: Synthetic peptide
AMCNVYIPPYCAMAPFGIFG

SEQ ID NO: 1148 - protein, 16 aa, Artificial Sequence
  Description of Artificial Sequence: Synthetic peptide
CPQPFPSQQPYLQLQG

SEQ ID NO: 1149 - protein, 18 aa, Artificial Sequence
  Description of Artificial Sequence: Synthetic peptide
CPQLQPQNPSQQQPQEQG

SEQ ID NO: 1150 - protein, 20 aa, Artificial Sequence
  Description of Artificial Sequence: Synthetic peptide
SQQPYLQLQPFPQPQLPYSQ

SEQ ID NO: 1151 - protein, 20 aa, Artificial Sequence
  Description of Artificial Sequence: Synthetic peptide
LQLQPFPQPQLPYSQPQPFR

SEQ ID NO: 1152 - protein, 20 aa, Artificial Sequence
  Description of Artificial Sequence: Synthetic peptide
LQLQPFPQPELPYSQPQPFR

SEQ ID NO: 1153 - protein, 15 aa, Artificial Sequence
  Description of Artificial Sequence: Synthetic peptide
QLQPFPQPQLPYSQP

SEQ ID NO: 1154 - protein, 15 aa, Artificial Sequence
  Description of Artificial Sequence: Synthetic peptide
LQPFPQPQLPYSQPQ

SEQ ID NO: 1155 - protein, 15 aa, Artificial Sequence
  Description of Artificial Sequence: Synthetic peptide
LQPFPQPELPYSQPQ

SEQ ID NO: 1156 - protein, 15 aa, Artificial Sequence
  Description of Artificial Sequence: Synthetic peptide
LQPFPQSQLPYSQPQ

SEQ ID NO: 1157 - protein, 15 aa, Artificial Sequence
  Description of Artificial Sequence: Synthetic peptide
LQPFPQSELPYSQPQ

SEQ ID NO: 1158 - protein, 12 aa, Artificial Sequence
  Description of Artificial Sequence: Synthetic peptide
QPFPQPQLPYSQ

SEQ ID NO: 1159 - protein, 12 aa, Artificial Sequence
  Description of Artificial Sequence: Synthetic peptide
QPFPQPELPYSQ

SEQ ID NO: 1160 - protein, 11 aa, Artificial Sequence
  Description of Artificial Sequence: Synthetic peptide
PFPQPQLPYSQ

SEQ ID NO: 1161 - protein, 11 aa, Artificial Sequence
  Description of Artificial Sequence: Synthetic peptide
PFPQPELPYSQ

SEQ ID NO: 1162 - protein, 19 aa, Artificial Sequence
  Description of Artificial Sequence: Synthetic peptide
QQYPLGQGSFRPSQQNPQA

SEQ ID NO: 1163 - protein, 20 aa, Artificial Sequence
  Description of Artificial Sequence: Synthetic peptide
VYIPPYCTIAPFGIFGTNYR

SEQ ID NO: 1164 - protein, 20 aa, Artificial Sequence
  Description of Artificial Sequence: Synthetic peptide
LQLQPFPQPQLPYLQPQPFR

SEQ ID NO: 1165 - protein, 20 aa, Artificial Sequence
  Description of Artificial Sequence: Synthetic peptide
LQLQPFPQPELPYLQPQPFR

SEQ ID NO: 1166 - protein, 15 aa, Artificial Sequence
  Description of Artificial Sequence: Synthetic peptide
QLQPFPQPQLPYLQP

SEQ ID NO: 1167 - protein, 12 aa, Artificial Sequence
  Description of Artificial Sequence: Synthetic peptide
QPFPQPQLPYLQ

SEQ ID NO: 1168 - protein, 12 aa, Artificial Sequence
  Description of Artificial Sequence: Synthetic peptide
QPFPQPELPYLQ

SEQ ID NO: 1169 - protein, 17 aa, Artificial Sequence
  Description of Artificial Sequence: Synthetic peptide
PPYCTIVPFGIFGTNYR

SEQ ID NO: 1170 - protein, 20 aa, Artificial Sequence
  Description of Artificial Sequence: Synthetic peptide
LQLQPFPQPQLPYPQPQPFR

SEQ ID NO: 1171 - protein, 17 aa, Artificial Sequence
  Description of Artificial Sequence: Synthetic peptide
QLQPFPQPQLPYPQPQP

SEQ ID NO: 1172 - protein, 17 aa, Artificial Sequence
  Description of Artificial Sequence: Synthetic peptide
QLQPFPQPELPYPQPQP

SEQ ID NO: 1173 - protein, 17 aa, Artificial Sequence
  Description of Artificial Sequence: Synthetic peptide
QLQPFPQPTLPYPQPQS

SEQ ID NO: 1174 - protein, 17 aa, Artificial Sequence
  Description of Artificial Sequence: Synthetic peptide
QLQPFPQPQLPYPQPQS

SEQ ID NO: 1175 - protein, 17 aa, Artificial Sequence
  Description of Artificial Sequence: Synthetic peptide
QLQPFPQPELPYPQPQS

SEQ ID NO: 1176 - protein, 20 aa, Artificial Sequence
  Description of Artificial Sequence: Synthetic peptide
LQPFPQPQPFLPQLPYPQPQ

SEQ ID NO: 1177 - protein, 17 aa, Artificial Sequence
  Description of Artificial Sequence: Synthetic peptide
PQPQPFLPQLPYPQPQS

SEQ ID NO: 1178 - protein, 17 aa, Artificial Sequence
  Description of Artificial Sequence: Synthetic peptide
PQPQPFLPELPYPQPQS

SEQ ID NO: 1179 - protein, 14 aa, Artificial Sequence
  Description of Artificial Sequence: Synthetic peptide
QPQPFLPQLPYPQP

SEQ ID NO: 1180 - protein, 14 aa, Artificial Sequence
  Description of Artificial Sequence: Synthetic peptide
EPQPFLPELPYPQP

SEQ ID NO: 1181 - protein, 12 aa, Artificial Sequence
  Description of Artificial Sequence: Synthetic peptide
PQPFLPQLPYPQ

SEQ ID NO: 1182 - protein, 20 aa, Artificial Sequence
  Description of Artificial Sequence: Synthetic peptide
FPGQQQQFPPQQPYPQPQPF

SEQ ID NO: 1183 - protein, 17 aa, Artificial Sequence
  Description of Artificial Sequence: Synthetic peptide
PQPQPFPPQLPYPQPQS

SEQ ID NO: 1184 - protein, 17 aa, Artificial Sequence
  Description of Artificial Sequence: Synthetic peptide
PQPQPFPPELPYPQPQS

SEQ ID NO: 1185 - protein, 20 aa, Artificial Sequence
  Description of Artificial Sequence: Synthetic peptide
PFTQPQQPTPIQPQQPFPQQ

SEQ ID NO: 1186 - protein, 11 aa, Artificial Sequence
  Description of Artificial Sequence: Synthetic peptide
PFTQPQQPTPI

SEQ ID NO: 1187 - protein, 20 aa, Artificial Sequence
  Description of Artificial Sequence: Synthetic peptide
TPIQPQQPFPQQPQQPQQPF

SEQ ID NO: 1188 - protein, 11 aa, Artificial Sequence
  Description of Artificial Sequence: Synthetic peptide
TPIQPQQPFPQ

SEQ ID NO: 1189 - protein, 12 aa, Artificial Sequence
  Description of Artificial Sequence: Synthetic peptide
PQQPFPQQPQQP

SEQ ID NO: 1190 - protein, 20 aa, Artificial Sequence
  Description of Artificial Sequence: Synthetic peptide
PQQPQQPQQPFPQPQQPFPW

SEQ ID NO: 1191 - protein, 20 aa, Artificial Sequence
  Description of Artificial Sequence: Synthetic peptide
PQQPQQPFPQPQQPFPWQPQ

SEQ ID NO: 1192 - protein, 15 aa, Artificial Sequence
  Description of Artificial Sequence: Synthetic peptide
PQQPQQPFPQPQQPF

SEQ ID NO: 1193 - protein, 15 aa, Artificial Sequence
  Description of Artificial Sequence: Synthetic peptide
QQPQQPFPQPQQPFP

SEQ ID NO: 1194 - protein, 17 aa, Artificial Sequence
  Description of Artificial Sequence: Synthetic peptide
QPQQPFPQPQQPFPWQP

SEQ ID NO: 1195 - protein, 17 aa, Artificial Sequence
  Description of Artificial Sequence: Synthetic peptide
QPEQPFPQPQQPFPWQP

SEQ ID NO: 1196 - protein, 17 aa, Artificial Sequence
  Description of Artificial Sequence: Synthetic peptide
QPEQPFPQPEQPFPWQP

SEQ ID NO: 1197 - protein, 17 aa, Artificial Sequence
  Description of Artificial Sequence: Synthetic peptide
QPQQPFPQPEQPFPWQP

SEQ ID NO: 1198 - protein, 14 aa, Artificial Sequence
  Description of Artificial Sequence: Synthetic peptide
KPFPQPEQPFPWQP

SEQ ID NO: 1199 - protein, 14 aa, Artificial Sequence
  Description of Artificial Sequence: Synthetic peptide
QKFPQPEQPFPWQP

SEQ ID NO: 1200 - protein, 14 aa, Artificial Sequence
  Description of Artificial Sequence: Synthetic peptide
QPKPQPEQPFPWQP

SEQ ID NO: 1201 - protein, 14 aa, Artificial Sequence
  Description of Artificial Sequence: Synthetic peptide
QPFPQPEQPFKWQP

SEQ ID NO: 1202 - protein, 14 aa, Artificial Sequence
  Description of Artificial Sequence: Synthetic peptide
QPFPQPEQPFPKQP

SEQ ID NO: 1203 - protein, 14 aa, Artificial Sequence
  Description of Artificial Sequence: Synthetic peptide
QPFPQPEQPFPWKP

SEQ ID NO: 1204 - protein, 14 aa, Artificial Sequence
  Description of Artificial Sequence: Synthetic peptide
QPFPQPEQPFPWQK

SEQ ID NO: 1205 - protein, 15 aa, Artificial Sequence
  Description of Artificial Sequence: Synthetic peptide
QPQQPFPQPQQPFPW

SEQ ID NO: 1206 - protein, 15 aa, Artificial Sequence
  Description of Artificial Sequence: Synthetic peptide
PQQPFPQPQQPFPWQ

SEQ ID NO: 1207 - protein, 15 aa, Artificial Sequence
  Description of Artificial Sequence: Synthetic peptide
QQPFPQPQQPFPWQP

SEQ ID NO: 1208 - protein, 15 aa, Artificial Sequence
  Description of Artificial Sequence: Synthetic peptide
EQPFPQPEQPFPWQP

SEQ ID NO: 1209 - protein, 20 aa, Artificial Sequence
  Description of Artificial Sequence: Synthetic peptide
QPFPQPQQPFPWQPQQPFPQ

SEQ ID NO: 1210 - protein, 20 aa, Artificial Sequence
  Description of Artificial Sequence: Synthetic peptide
QPFPQPEQPFPWQPQQPFPQ

SEQ ID NO: 1211 - protein, 12 aa, Artificial Sequence
  Description of Artificial Sequence: Synthetic peptide
QPFPQPQQPFPW

SEQ ID NO: 1212 - protein, 12 aa, Artificial Sequence
  Description of Artificial Sequence: Synthetic peptide
QPFPQPEQPFPW

SEQ ID NO: 1213 - protein, 9 aa, Artificial Sequence
  Description of Artificial Sequence: Synthetic peptide
PQPEQPFPW

SEQ ID NO: 1214 - protein, 9 aa, Artificial Sequence
  Description of Artificial Sequence: Synthetic peptide
PQPQQPFPW

SEQ ID NO: 1215 - protein, 12 aa, Artificial Sequence
  Description of Artificial Sequence: Synthetic peptide
PFPWQPQQPFPQ

SEQ ID NO: 1216 - protein, 12 aa, Artificial Sequence
  Description of Artificial Sequence: Synthetic peptide
PFPWQPEQPFPQ

SEQ ID NO: 1217 - protein, 20 aa, Artificial Sequence
  Description of Artificial Sequence: Synthetic peptide
PLQPQQPFPQQPQQPFPQPQ

SEQ ID NO: 1218 - protein, 20 aa, Artificial Sequence
  Description of Artificial Sequence: Synthetic peptide
FPQQPQQPFPQPQLPFPQQS

SEQ ID NO: 1219 - protein, 20 aa, Artificial Sequence
  Description of Artificial Sequence: Synthetic peptide
QQPQQPFPQPQLPFPQQSEQ

SEQ ID NO: 1220 - protein, 12 aa, Artificial Sequence
  Description of Artificial Sequence: Synthetic peptide
QPFPQPQLPFPQ

SEQ ID NO: 1221 - protein, 20 aa, Artificial Sequence
  Description of Artificial Sequence: Synthetic peptide
QQPFPQQPQQPFPQPQQPIP

SEQ ID NO: 1222 - protein, 12 aa, Artificial Sequence
  Description of Artificial Sequence: Synthetic peptide
PFPQQPQQPFPQ

SEQ ID NO: 1223 - protein, 20 aa, Artificial Sequence
  Description of Artificial Sequence: Synthetic peptide
PQQPQQPFPQPQQPIPVQPQ

SEQ ID NO: 1224 - protein, 11 aa, Artificial Sequence
  Description of Artificial Sequence: Synthetic peptide
PFPQPQQPIPV

SEQ ID NO: 1225 - protein, 20 aa, Artificial Sequence
  Description of Artificial Sequence: Synthetic peptide
QPQQPIPVQPQQSFPQQSQQ

SEQ ID NO: 1226 - protein, 20 aa, Artificial Sequence
  Description of Artificial Sequence: Synthetic peptide
FPELQQPIPQQPQQPFPLQP

SEQ ID NO: 1227 - protein, 12 aa, Artificial Sequence
  Description of Artificial Sequence: Synthetic peptide
PIPQQPQQPFPL

SEQ ID NO: 1228 - protein, 20 aa, Artificial Sequence
  Description of Artificial Sequence: Synthetic peptide
PQQPQQPFPLQPQQPFPQQP

SEQ ID NO: 1229 - protein, 12 aa, Artificial Sequence
  Description of Artificial Sequence: Synthetic peptide
PFPLQPQQPFPQ

SEQ ID NO: 1230 - protein, 20 aa, Artificial Sequence
  Description of Artificial Sequence: Synthetic peptide
PFPQQPQQPFPQQPQQSFPQ

SEQ ID NO: 1231 - protein, 12 aa, Artificial Sequence
  Description of Artificial Sequence: Synthetic peptide
QQQQIPQQPQQF

SEQ ID NO: 1232 - protein, 12 aa, Artificial Sequence
  Description of Artificial Sequence: Synthetic peptide
QQQQLPQQPQQF

SEQ ID NO: 1233 - protein, 12 aa, Artificial Sequence
  Description of Artificial Sequence: Synthetic peptide
QEQQIPEQPQQF

SEQ ID NO: 1234 - protein, 12 aa, Artificial Sequence
  Description of Artificial Sequence: Synthetic peptide
QEQQLPEQPQQF

SEQ ID NO: 1235 - protein, 9 aa, Artificial Sequence
  Description of Artificial Sequence: Synthetic peptide
QIPQQPQQF

SEQ ID NO: 1236 - protein, 9 aa, Artificial Sequence
  Description of Artificial Sequence: Synthetic peptide
QIPEQPQQF

SEQ ID NO: 1237 - protein, 9 aa, Artificial Sequence
  Description of Artificial Sequence: Synthetic peptide
QLPQQPQQF

SEQ ID NO: 1238 - protein, 9 aa, Artificial Sequence
  Description of Artificial Sequence: Synthetic peptide
QLPEQPQQF

SEQ ID NO: 1239 - protein, 9 aa, Artificial Sequence
  Description of Artificial Sequence: Synthetic peptide
EIPEQPQQF

SEQ ID NO: 1240 - protein, 9 aa, Artificial Sequence
  Description of Artificial Sequence: Synthetic peptide
ELPEQPQQF

SEQ ID NO: 1241 - protein, 21 aa, Artificial Sequence
  Description of Artificial Sequence: Synthetic peptide
QQISQPQIPQQQQIPQQPQQF

SEQ ID NO: 1242 - protein, 21 aa, Artificial Sequence
  Description of Artificial Sequence: Synthetic peptide
QEISQPQIPQQQQIPQQPQQF

SEQ ID NO: 1243 - protein, 21 aa, Artificial Sequence
  Description of Artificial Sequence: Synthetic peptide
QQISQPEIPQQQQIPQQPQQF

SEQ ID NO: 1244 - protein, 21 aa, Artificial Sequence
  Description of Artificial Sequence: Synthetic peptide
QQISQPQIPQEQQIPQQPQQF

SEQ ID NO: 1245 - protein, 21 aa, Artificial Sequence
  Description of Artificial Sequence: Synthetic peptide
QQISQPQIPQQQEIPQQPQQF

SEQ ID NO: 1246 - protein, 21 aa, Artificial Sequence
  Description of Artificial Sequence: Synthetic peptide
QEISQPEIPQQQQIPQQPQQF

SEQ ID NO: 1247 - protein, 21 aa, Artificial Sequence
  Description of Artificial Sequence: Synthetic peptide
QEISQPQIPQEQQIPQQPQQF

SEQ ID NO: 1248 - protein, 21 aa, Artificial Sequence
  Description of Artificial Sequence: Synthetic peptide
QEISQPQIPQQQEIPQQPQQF

SEQ ID NO: 1249 - protein, 21 aa, Artificial Sequence
  Description of Artificial Sequence: Synthetic peptide
QQISQPEIPQEQQIPQQPQQF

SEQ ID NO: 1250 - protein, 21 aa, Artificial Sequence
  Description of Artificial Sequence: Synthetic peptide
QQISQPEIPQQQEIPQQPQQF

SEQ ID NO: 1251 - protein, 21 aa, Artificial Sequence
  Description of Artificial Sequence: Synthetic peptide
QQISQPQIPQEQEIPQQPQQF

SEQ ID NO: 1252 - protein, 21 aa, Artificial Sequence
  Description of Artificial Sequence: Synthetic peptide
QEISQPEIPQEQQIPQQPQQF

SEQ ID NO: 1253 - protein, 21 aa, Artificial Sequence
  Description of Artificial Sequence: Synthetic peptide
QEISQPEIPQQQEIPQQPQQF

SEQ ID NO: 1254 - protein, 21 aa, Artificial Sequence
  Description of Artificial Sequence: Synthetic peptide
QEISQPQIPQEQEIPQQPQQF

SEQ ID NO: 1255 - protein, 21 aa, Artificial Sequence
  Description of Artificial Sequence: Synthetic peptide
QQISQPEIPQEQEIPQQPQQF

SEQ ID NO: 1256 - protein, 21 aa, Artificial Sequence
  Description of Artificial Sequence: Synthetic peptide
QEISQPEIPQEQEIPQQPQQF

SEQ ID NO: 1257 - protein, 21 aa, Artificial Sequence
  Description of Artificial Sequence: Synthetic peptide
QQISQPQLPQQQQIPQQPQQF

SEQ ID NO: 1258 - protein, 21 aa, Artificial Sequence
  Description of Artificial Sequence: Synthetic peptide
QEISQPQLPQQQQIPQQPQQF

SEQ ID NO: 1259 - protein, 21 aa, Artificial Sequence
  Description of Artificial Sequence: Synthetic peptide
QQISQPELPQQQQIPQQPQQF

SEQ ID NO: 1260 - protein, 21 aa, Artificial Sequence
  Description of Artificial Sequence: Synthetic peptide
QQISQPQLPQEQQIPQQPQQF

SEQ ID NO: 1261 - protein, 21 aa, Artificial Sequence
  Description of Artificial Sequence: Synthetic peptide
QQISQPQLPQQQEIPQQPQQF

SEQ ID NO: 1262 - protein, 21 aa, Artificial Sequence
  Description of Artificial Sequence: Synthetic peptide
QEISQPELPQQQQIPQQPQQF

SEQ ID NO: 1263 - protein, 21 aa, Artificial Sequence
  Description of Artificial Sequence: Synthetic peptide
QEISQPQLPQEQQIPQQPQQF

SEQ ID NO: 1264 - protein, 21 aa, Artificial Sequence
  Description of Artificial Sequence: Synthetic peptide
QEISQPQLPQQQEIPQQPQQF

SEQ ID NO: 1265 - protein, 21 aa, Artificial Sequence
  Description of Artificial Sequence: Synthetic peptide
QQISQPELPQEQQIPQQPQQF

SEQ ID NO: 1266 - protein, 21 aa, Artificial Sequence
  Description of Artificial Sequence: Synthetic peptide
QQISQPELPQQQEIPQQPQQF

SEQ ID NO: 1267 - protein, 21 aa, Artificial Sequence
  Description of Artificial Sequence: Synthetic peptide
QQISQPQLPQEQEIPQQPQQF

SEQ ID NO: 1268 - protein, 21 aa, Artificial Sequence
  Description of Artificial Sequence: Synthetic peptide
QEISQPELPQEQQIPQQPQQF

SEQ ID NO: 1269 - protein, 21 aa, Artificial Sequence
  Description of Artificial Sequence: Synthetic peptide
QEISQPELPQQQEIPQQPQQF

SEQ ID NO: 1270 - protein, 21 aa, Artificial Sequence
  Description of Artificial Sequence: Synthetic peptide
QEISQPQLPQEQEIPQQPQQF

SEQ ID NO: 1271 - protein, 21 aa, Artificial Sequence
  Description of Artificial Sequence: Synthetic peptide
QQISQPELPQEQEIPQQPQQF

SEQ ID NO: 1272 - protein, 21 aa, Artificial Sequence
  Description of Artificial Sequence: Synthetic peptide
QEISQPELPQEQEIPQQPQQF

SEQ ID NO: 1273 - protein, 21 aa, Artificial Sequence
  Description of Artificial Sequence: Synthetic peptide
QQISQPQIPQQQQLPQQPQQF

SEQ ID NO: 1274 - protein, 21 aa, Artificial Sequence
  Description of Artificial Sequence: Synthetic peptide
QEISQPQIPQQQQLPQQPQQF

SEQ ID NO: 1275 - protein, 21 aa, Artificial Sequence
  Description of Artificial Sequence: Synthetic peptide
QQISQPEIPQQQQLPQQPQQF

SEQ ID NO: 1276 - protein, 21 aa, Artificial Sequence
  Description of Artificial Sequence: Synthetic peptide
QQISQPQIPQEQQLPQQPQQF

SEQ ID NO: 1277 - protein, 21 aa, Artificial Sequence
  Description of Artificial Sequence: Synthetic peptide
QQISQPQIPQQQELPQQPQQF

SEQ ID NO: 1278 - protein, 21 aa, Artificial Sequence
  Description of Artificial Sequence: Synthetic peptide
QEISQPEIPQQQQLPQQPQQF

SEQ ID NO: 1279 - protein, 21 aa, Artificial Sequence
  Description of Artificial Sequence: Synthetic peptide
QEISQPQIPQEQQLPQQPQQF

SEQ ID NO: 1280 - protein, 21 aa, Artificial Sequence
  Description of Artificial Sequence: Synthetic peptide
QEISQPQIPQQQELPQQPQQF

SEQ ID NO: 1281 - protein, 21 aa, Artificial Sequence
  Description of Artificial Sequence: Synthetic peptide
QQISQPEIPQEQQLPQQPQQF

SEQ ID NO: 1282 - protein, 21 aa, Artificial Sequence
  Description of Artificial Sequence: Synthetic peptide
QQISQPEIPQQQELPQQPQQF

SEQ ID NO: 1283 - protein, 21 aa, Artificial Sequence
  Description of Artificial Sequence: Synthetic peptide
QQISQPQIPQEQELPQQPQQF

SEQ ID NO: 1284 - protein, 21 aa, Artificial Sequence
  Description of Artificial Sequence: Synthetic peptide
QEISQPEIPQEQQLPQQPQQF

SEQ ID NO: 1285 - protein, 21 aa, Artificial Sequence
  Description of Artificial Sequence: Synthetic peptide
QEISQPEIPQQQELPQQPQQF

SEQ ID NO: 1286 - protein, 21 aa, Artificial Sequence
  Description of Artificial Sequence: Synthetic peptide
QEISQPQIPQEQELPQQPQQF

SEQ ID NO: 1287 - protein, 21 aa, Artificial Sequence
  Description of Artificial Sequence: Synthetic peptide
QQISQPEIPQEQELPQQPQQF

SEQ ID NO: 1288 - protein, 21 aa, Artificial Sequence
  Description of Artificial Sequence: Synthetic peptide
QEISQPEIPQEQELPQQPQQF

SEQ ID NO: 1289 - protein, 21 aa, Artificial Sequence
  Description of Artificial Sequence: Synthetic peptide
QQLSQPQIPQQQQIPQQPQQF

SEQ ID NO: 1290 - protein, 21 aa, Artificial Sequence
  Description of Artificial Sequence: Synthetic peptide
QELSQPQIPQQQQIPQQPQQF

SEQ ID NO: 1291 - protein, 21 aa, Artificial Sequence
  Description of Artificial Sequence: Synthetic peptide
QQLSQPEIPQQQQIPQQPQQF

SEQ ID NO: 1292 - protein, 21 aa, Artificial Sequence
  Description of Artificial Sequence: Synthetic peptide
QQLSQPQIPQEQQIPQQPQQF

SEQ ID NO: 1293 - protein, 21 aa, Artificial Sequence
  Description of Artificial Sequence: Synthetic peptide
QQLSQPQIPQQQEIPQQPQQF

SEQ ID NO: 1294 - protein, 21 aa, Artificial Sequence
  Description of Artificial Sequence: Synthetic peptide
QELSQPEIPQQQQIPQQPQQF

SEQ ID NO: 1295 - protein, 21 aa, Artificial Sequence
  Description of Artificial Sequence: Synthetic peptide
QELSQPQIPQEQQIPQQPQQF

SEQ ID NO: 1296 - protein, 21 aa, Artificial Sequence
  Description of Artificial Sequence: Synthetic peptide
QELSQPQIPQQQEIPQQPQQF

SEQ ID NO: 1297 - protein, 21 aa, Artificial Sequence
  Description of Artificial Sequence: Synthetic peptide
QQLSQPEIPQEQQIPQQPQQF

SEQ ID NO: 1298 - protein, 21 aa, Artificial Sequence
  Description of Artificial Sequence: Synthetic peptide
QQLSQPEIPQQQEIPQQPQQF

SEQ ID NO: 1299 - protein, 21 aa, Artificial Sequence
  Description of Artificial Sequence: Synthetic peptide
QQLSQPQIPQEQEIPQQPQQF

SEQ ID NO: 1300 - protein, 21 aa, Artificial Sequence
  Description of Artificial Sequence: Synthetic peptide
QELSQPEIPQEQQIPQQPQQF

SEQ ID NO: 1301 - protein, 21 aa, Artificial Sequence
  Description of Artificial Sequence: Synthetic peptide
QELSQPEIPQQQEIPQQPQQF

SEQ ID NO: 1302 - protein, 21 aa, Artificial Sequence
  Description of Artificial Sequence: Synthetic peptide
QELSQPQIPQEQEIPQQPQQF

SEQ ID NO: 1303 - protein, 21 aa, Artificial Sequence
  Description of Artificial Sequence: Synthetic peptide
QQLSQPEIPQEQEIPQQPQQF

SEQ ID NO: 1304 - protein, 21 aa, Artificial Sequence
  Description of Artificial Sequence: Synthetic peptide
QELSQPEIPQEQEIPQQPQQF

SEQ ID NO: 1305 - protein, 21 aa, Artificial Sequence
  Description of Artificial Sequence: Synthetic peptide
QQLSQPQLPQQQQIPQQPQQF

SEQ ID NO: 1306 - protein, 21 aa, Artificial Sequence
  Description of Artificial Sequence: Synthetic peptide
QELSQPQLPQQQQIPQQPQQF

SEQ ID NO: 1307 - protein, 21 aa, Artificial Sequence
  Description of Artificial Sequence: Synthetic peptide
QQLSQPELPQQQQIPQQPQQF

SEQ ID NO: 1308 - protein, 21 aa, Artificial Sequence
  Description of Artificial Sequence: Synthetic peptide
QQLSQPQLPQEQQIPQQPQQF

SEQ ID NO: 1309 - protein, 21 aa, Artificial Sequence
  Description of Artificial Sequence: Synthetic peptide
QQLSQPQLPQQQEIPQQPQQF

SEQ ID NO: 1310 - protein, 21 aa, Artificial Sequence
  Description of Artificial Sequence: Synthetic peptide
QELSQPELPQQQQIPQQPQQF

SEQ ID NO: 1311 - protein, 21 aa, Artificial Sequence
  Description of Artificial Sequence: Synthetic peptide
QELSQPQLPQEQQIPQQPQQF

SEQ ID NO: 1312 - protein, 21 aa, Artificial Sequence
  Description of Artificial Sequence: Synthetic peptide
QELSQPQLPQQQEIPQQPQQF

SEQ ID NO: 1313 - protein, 21 aa, Artificial Sequence
  Description of Artificial Sequence: Synthetic peptide
QQLSQPELPQEQQIPQQPQQF

SEQ ID NO: 1314 - protein, 21 aa, Artificial Sequence
  Description of Artificial Sequence: Synthetic peptide
QQLSQPELPQQQEIPQQPQQF

SEQ ID NO: 1315 - protein, 21 aa, Artificial Sequence
  Description of Artificial Sequence: Synthetic peptide
QQLSQPQLPQEQEIPQQPQQF

SEQ ID NO: 1316 - protein, 21 aa, Artificial Sequence
  Description of Artificial Sequence: Synthetic peptide
QELSQPELPQEQQIPQQPQQF

SEQ ID NO: 1317 - protein, 21 aa, Artificial Sequence
  Description of Artificial Sequence: Synthetic peptide
QELSQPELPQQQEIPQQPQQF

SEQ ID NO: 1318 - protein, 21 aa, Artificial Sequence
  Description of Artificial Sequence: Synthetic peptide
QELSQPQLPQEQEIPQQPQQF

SEQ ID NO: 1319 - protein, 21 aa, Artificial Sequence
  Description of Artificial Sequence: Synthetic peptide
QQLSQPELPQEQEIPQQPQQF

SEQ ID NO: 1320 - protein, 21 aa, Artificial Sequence
  Description of Artificial Sequence: Synthetic peptide
QELSQPELPQEQEIPQQPQQF

SEQ ID NO: 1321 - protein, 21 aa, Artificial Sequence
  Description of Artificial Sequence: Synthetic peptide
QQLSQPQIPQQQQLPQQPQQF

SEQ ID NO: 1322 - protein, 21 aa, Artificial Sequence
  Description of Artificial Sequence: Synthetic peptide
QELSQPQIPQQQQLPQQPQQF

SEQ ID NO: 1323 - protein, 21 aa, Artificial Sequence
  Description of Artificial Sequence: Synthetic peptide
QQLSQPEIPQQQQLPQQPQQF

SEQ ID NO: 1324 - protein, 21 aa, Artificial Sequence
  Description of Artificial Sequence: Synthetic peptide
QQLSQPQIPQEQQLPQQPQQF

SEQ ID NO: 1325 - protein, 21 aa, Artificial Sequence
  Description of Artificial Sequence: Synthetic peptide
QQLSQPQIPQQQELPQQPQQF

SEQ ID NO: 1326 - protein, 21 aa, Artificial Sequence
  Description of Artificial Sequence: Synthetic peptide
QELSQPEIPQQQQLPQQPQQF

SEQ ID NO: 1327 - protein, 21 aa, Artificial Sequence
  Description of Artificial Sequence: Synthetic peptide
QELSQPQIPQEQQLPQQPQQF

SEQ ID NO: 1328 - protein, 21 aa, Artificial Sequence
  Description of Artificial Sequence: Synthetic peptide
QELSQPQIPQQQELPQQPQQF

SEQ ID NO: 1329 - protein, 21 aa, Artificial Sequence
  Description of Artificial Sequence: Synthetic peptide
QQLSQPEIPQEQQLPQQPQQF

SEQ ID NO: 1330 - protein, 21 aa, Artificial Sequence
  Description of Artificial Sequence: Synthetic peptide
QQLSQPEIPQQQELPQQPQQF

SEQ ID NO: 1331 - protein, 21 aa, Artificial Sequence
  Description of Artificial Sequence: Synthetic peptide
QQLSQPQIPQEQELPQQPQQF

SEQ ID NO: 1332 - protein, 21 aa, Artificial Sequence
  Description of Artificial Sequence: Synthetic peptide
QELSQPEIPQEQQLPQQPQQF

SEQ ID NO: 1333 - protein, 21 aa, Artificial Sequence
  Description of Artificial Sequence: Synthetic peptide
QELSQPEIPQQQELPQQPQQF

SEQ ID NO: 1334 - protein, 21 aa, Artificial Sequence
  Description of Artificial Sequence: Synthetic peptide
QELSQPQIPQEQELPQQPQQF

SEQ ID NO: 1335 - protein, 21 aa, Artificial Sequence
  Description of Artificial Sequence: Synthetic peptide
QQLSQPEIPQEQELPQQPQQF

SEQ ID NO: 1336 - protein, 21 aa, Artificial Sequence
  Description of Artificial Sequence: Synthetic peptide
QELSQPEIPQEQELPQQPQQF

SEQ ID NO: 1337 - protein, 21 aa, Artificial Sequence
  Description of Artificial Sequence: Synthetic peptide
QQISQPQLPQQQQLPQQPQQF

SEQ ID NO: 1338 - protein, 21 aa, Artificial Sequence
  Description of Artificial Sequence: Synthetic peptide
QEISQPQLPQQQQLPQQPQQF

SEQ ID NO: 1339 - protein, 21 aa, Artificial Sequence
  Description of Artificial Sequence: Synthetic peptide
QQISQPELPQQQQLPQQPQQF

SEQ ID NO: 1340 - protein, 21 aa, Artificial Sequence
  Description of Artificial Sequence: Synthetic peptide
QQISQPQLPQEQQLPQQPQQF

SEQ ID NO: 1341 - protein, 21 aa, Artificial Sequence
  Description of Artificial Sequence: Synthetic peptide
QQISQPQLPQQQELPQQPQQF

SEQ ID NO: 1342 - protein, 21 aa, Artificial Sequence
  Description of Artificial Sequence: Synthetic peptide
QEISQPELPQQQQLPQQPQQF

SEQ ID NO: 1343 - protein, 21 aa, Artificial Sequence
  Description of Artificial Sequence: Synthetic peptide
QEISQPQLPQEQQLPQQPQQF

SEQ ID NO: 1344 - protein, 21 aa, Artificial Sequence
  Description of Artificial Sequence: Synthetic peptide
QEISQPQLPQQQELPQQPQQF

SEQ ID NO: 1345 - protein, 21 aa, Artificial Sequence
  Description of Artificial Sequence: Synthetic peptide
QQISQPELPQEQQLPQQPQQF

SEQ ID NO: 1346 - protein, 21 aa, Artificial Sequence
  Description of Artificial Sequence: Synthetic peptide
QQISQPELPQQQELPQQPQQF

SEQ ID NO: 1347 - protein, 21 aa, Artificial Sequence
  Description of Artificial Sequence: Synthetic peptide
QQISQPQLPQEQELPQQPQQF

SEQ ID NO: 1348 - protein, 21 aa, Artificial Sequence
  Description of Artificial Sequence: Synthetic peptide
QEISQPELPQEQQLPQQPQQF

SEQ ID NO: 1349 - protein, 21 aa, Artificial Sequence
  Description of Artificial Sequence: Synthetic peptide
QEISQPELPQQQELPQQPQQF

SEQ ID NO: 1350 - protein, 21 aa, Artificial Sequence
  Description of Artificial Sequence: Synthetic peptide
QEISQPQLPQEQELPQQPQQF

SEQ ID NO: 1351 - protein, 21 aa, Artificial Sequence
  Description of Artificial Sequence: Synthetic peptide
QQISQPELPQEQELPQQPQQF

SEQ ID NO: 1352 - protein, 21 aa, Artificial Sequence
  Description of Artificial Sequence: Synthetic peptide
QEISQPELPQEQELPQQPQQF

SEQ ID NO: 1353 - protein, 21 aa, Artificial Sequence
  Description of Artificial Sequence: Synthetic peptide
QQLSQPQLPQQQQLPQQPQQF

SEQ ID NO: 1354 - protein, 21 aa, Artificial Sequence
  Description of Artificial Sequence: Synthetic peptide
QELSQPQLPQQQQLPQQPQQF

SEQ ID NO: 1355 - protein, 21 aa, Artificial Sequence
  Description of Artificial Sequence: Synthetic peptide
QQLSQPELPQQQQLPQQPQQF

SEQ ID NO: 1356 - protein, 21 aa, Artificial Sequence
  Description of Artificial Sequence: Synthetic peptide
QQLSQPQLPQEQQLPQQPQQF

SEQ ID NO: 1357 - protein, 21 aa, Artificial Sequence
  Description of Artificial Sequence: Synthetic peptide
QQLSQPQLPQQQELPQQPQQF

SEQ ID NO: 1358 - protein, 21 aa, Artificial Sequence
  Description of Artificial Sequence: Synthetic peptide
QELSQPELPQQQQLPQQPQQF

SEQ ID NO: 1359 - protein, 21 aa, Artificial Sequence
  Description of Artificial Sequence: Synthetic peptide
QELSQPQLPQEQQLPQQPQQF

SEQ ID NO: 1360 - protein, 21 aa, Artificial Sequence
  Description of Artificial Sequence: Synthetic peptide
QELSQPQLPQQQELPQQPQQF

SEQ ID NO: 1361 - protein, 21 aa, Artificial Sequence
  Description of Artificial Sequence: Synthetic peptide
QQLSQPELPQEQQLPQQPQQF

SEQ ID NO: 1362 - protein, 21 aa, Artificial Sequence
  Description of Artificial Sequence: Synthetic peptide
QQLSQPELPQQQELPQQPQQF

SEQ ID NO: 1363 - protein, 21 aa, Artificial Sequence
  Description of Artificial Sequence: Synthetic peptide
QQLSQPQLPQEQELPQQPQQF

SEQ ID NO: 1364 - protein, 21 aa, Artificial Sequence
  Description of Artificial Sequence: Synthetic peptide
QELSQPELPQEQQLPQQPQQF

SEQ ID NO: 1365 - protein, 21 aa, Artificial Sequence
  Description of Artificial Sequence: Synthetic peptide
QELSQPELPQQQELPQQPQQF

SEQ ID NO: 1366 - protein, 21 aa, Artificial Sequence
  Description of Artificial Sequence: Synthetic peptide
QELSQPQLPQEQELPQQPQQF

SEQ ID NO: 1367 - protein, 21 aa, Artificial Sequence
  Description of Artificial Sequence: Synthetic peptide
QQLSQPELPQEQELPQQPQQF

SEQ ID NO: 1368 - protein, 21 aa, Artificial Sequence
  Description of Artificial Sequence: Synthetic peptide
QELSQPELPQEQELPQQPQQF

SEQ ID NO: 1369 - protein, 20 aa, Artificial Sequence
  Description of Artificial Sequence: Synthetic peptide
QQFLQPQQPFPQQPQQPYPQ

SEQ ID NO: 1370 - protein, 17 aa, Artificial Sequence
  Description of Artificial Sequence: Synthetic peptide
QQFLQPQQPFPQQPQQP

SEQ ID NO: 1371 - protein, 26 aa, Artificial Sequence
  Description of Artificial Sequence: Synthetic peptide
FLQPQQPFPQQPQQPYPQQPQQPFPQ

SEQ ID NO: 1372 - protein, 26 aa, Artificial Sequence
  Description of Artificial Sequence: Synthetic peptide
FLQPEQPFPQQPQQPYPQQPQQPFPQ

SEQ ID NO: 1373 - protein, 26 aa, Artificial Sequence
  Description of Artificial Sequence: Synthetic peptide
FLQPQQPFPEQPQQPYPQQPQQPFPQ

SEQ ID NO: 1374 - protein, 26 aa, Artificial Sequence
  Description of Artificial Sequence: Synthetic peptide
FLQPQQPFPQQPEQPYPQQPQQPFPQ

SEQ ID NO: 1375 - protein, 26 aa, Artificial Sequence
  Description of Artificial Sequence: Synthetic peptide
FLQPQQPFPQQPQQPYPEQPQQPFPQ

SEQ ID NO: 1376 - protein, 26 aa, Artificial Sequence
  Description of Artificial Sequence: Synthetic peptide
FLQPQQPFPQQPQQPYPQQPEQPFPQ

SEQ ID NO: 1377 - protein, 26 aa, Artificial Sequence
  Description of Artificial Sequence: Synthetic peptide
FLQPEQPFPEQPQQPYPQQPQQPFPQ

SEQ ID NO: 1378 - protein, 26 aa, Artificial Sequence
  Description of Artificial Sequence: Synthetic peptide
FLQPEQPFPQQPEQPYPQQPQQPFPQ

SEQ ID NO: 1379 - protein, 26 aa, Artificial Sequence
  Description of Artificial Sequence: Synthetic peptide
FLQPEQPFPQQPQQPYPEQPQQPFPQ

SEQ ID NO: 1380 - protein, 26 aa, Artificial Sequence
  Description of Artificial Sequence: Synthetic peptide
FLQPEQPFPQQPQQPYPQQPEQPFPQ

SEQ ID NO: 1381 - protein, 26 aa, Artificial Sequence
  Description of Artificial Sequence: Synthetic peptide
FLQPQQPFPEQPEQPYPQQPQQPFPQ

SEQ ID NO: 1382 - protein, 26 aa, Artificial Sequence
  Description of Artificial Sequence: Synthetic peptide
FLQPQQPFPEQPQQPYPEQPQQPFPQ

SEQ ID NO: 1383 - protein, 26 aa, Artificial Sequence
  Description of Artificial Sequence: Synthetic peptide
FLQPQQPFPEQPQQPYPQQPEQPFPQ

SEQ ID NO: 1384 - protein, 26 aa, Artificial Sequence
  Description of Artificial Sequence: Synthetic peptide
FLQPQQPFPQQPEQPYPEQPQQPFPQ

SEQ ID NO: 1385 - protein, 26 aa, Artificial Sequence
  Description of Artificial Sequence: Synthetic peptide
FLQPQQPFPQQPEQPYPQQPEQPFPQ

SEQ ID NO: 1386 - protein, 26 aa, Artificial Sequence
  Description of Artificial Sequence: Synthetic peptide
FLQPQQPFPQQPQQPYPEQPEQPFPQ

SEQ ID NO: 1387 - protein, 26 aa, Artificial Sequence
  Description of Artificial Sequence: Synthetic peptide
FLQPEQPFPEQPEQPYPQQPQQPFPQ

SEQ ID NO: 1388 - protein, 26 aa, Artificial Sequence
  Description of Artificial Sequence: Synthetic peptide
FLQPEQPFPEQPQQPYPEQPQQPFPQ

SEQ ID NO: 1389 - protein, 26 aa, Artificial Sequence
  Description of Artificial Sequence: Synthetic peptide
FLQPEQPFPEQPQQPYPQQPEQPFPQ

SEQ ID NO: 1390 - protein, 26 aa, Artificial Sequence
  Description of Artificial Sequence: Synthetic peptide
FLQPQQPFPEQPEQPYPEQPQQPFPQ

SEQ ID NO: 1391 - protein, 26 aa, Artificial Sequence
  Description of Artificial Sequence: Synthetic peptide
FLQPQQPFPEQPEQPYPQQPEQPFPQ

SEQ ID NO: 1392 - protein, 26 aa, Artificial Sequence
  Description of Artificial Sequence: Synthetic peptide
FLQPQQPFPQQPEQPYPEQPEQPFPQ

SEQ ID NO: 1393 - protein, 26 aa, Artificial Sequence
  Description of Artificial Sequence: Synthetic peptide
FLQPEQPFPEQPEQPYPEQPEQPFPQ

SEQ ID NO: 1394 - protein, 20 aa, Artificial Sequence
  Description of Artificial Sequence: Synthetic peptide
LQPQQPFPQQPQQPYPQQPQ

SEQ ID NO: 1395 - protein, 20 aa, Artificial Sequence
  Description of Artificial Sequence: Synthetic peptide
LQPEQPFPQQPQQPYPQQPQ

SEQ ID NO: 1396 - protein, 20 aa, Artificial Sequence
  Description of Artificial Sequence: Synthetic peptide
LQPQQPFPEQPQQPYPQQPQ

SEQ ID NO: 1397 - protein, 20 aa, Artificial Sequence
  Description of Artificial Sequence: Synthetic peptide
LQPQQPFPQQPEQPYPQQPQ

SEQ ID NO: 1398 - protein, 20 aa, Artificial Sequence
  Description of Artificial Sequence: Synthetic peptide
LQPQQPFPQQPQQPYPEQPQ

SEQ ID NO: 1399 - protein, 20 aa, Artificial Sequence
  Description of Artificial Sequence: Synthetic peptide
LQPEQPFPEQPQQPYPQQPQ

SEQ ID NO: 1400 - protein, 20 aa, Artificial Sequence
  Description of Artificial Sequence: Synthetic peptide
LQPEQPFPQQPEQPYPQQPQ

SEQ ID NO: 1401 - protein, 20 aa, Artificial Sequence
  Description of Artificial Sequence: Synthetic peptide
LQPEQPFPQQPQQPYPEQPQ

SEQ ID NO: 1402 - protein, 20 aa, Artificial Sequence
  Description of Artificial Sequence: Synthetic peptide
LQPQQPFPEQPEQPYPQQPQ

SEQ ID NO: 1403 - protein, 20 aa, Artificial Sequence
  Description of Artificial Sequence: Synthetic peptide
LQPQQPFPEQPQQPYPEQPQ

SEQ ID NO: 1404 - protein, 20 aa, Artificial Sequence
  Description of Artificial Sequence: Synthetic peptide
LQPQQPFPQQPEQPYPEQPQ

SEQ ID NO: 1405 - protein, 20 aa, Artificial Sequence
  Description of Artificial Sequence: Synthetic peptide
LQPEQPFPEQPEQPYPQQPQ

SEQ ID NO: 1406 - protein, 20 aa, Artificial Sequence
  Description of Artificial Sequence: Synthetic peptide
LQPEQPFPEQPQQPYPEQPQ

SEQ ID NO: 1407 - protein, 20 aa, Artificial Sequence
  Description of Artificial Sequence: Synthetic peptide
LQPQQPFPEQPEQPYPEQPQ

SEQ ID NO: 1408 - protein, 20 aa, Artificial Sequence
  Description of Artificial Sequence: Synthetic peptide
LQPEQPFPEQPEQPYPEQPQ

SEQ ID NO: 1409 - protein, 17 aa, Artificial Sequence
  Description of Artificial Sequence: Synthetic peptide
PQQPFPQQPQQPYPQQP

SEQ ID NO: 1410 - protein, 13 aa, Artificial Sequence
  Description of Artificial Sequence: Synthetic peptide
PQQPFPQQPQQPY

SEQ ID NO: 1411 - protein, 13 aa, Artificial Sequence
  Description of Artificial Sequence: Synthetic peptide
PQQPFPEQPQQPY

SEQ ID NO: 1412 - protein, 13 aa, Artificial Sequence
  Description of Artificial Sequence: Synthetic peptide
PEQPFPEQPQQPY

SEQ ID NO: 1413 - protein, 13 aa, Artificial Sequence
  Description of Artificial Sequence: Synthetic peptide
PQQPFPEQPEQPY

SEQ ID NO: 1414 - protein, 13 aa, Artificial Sequence
  Description of Artificial Sequence: Synthetic peptide
PEQPFPEQPEQPY

SEQ ID NO: 1415 - protein, 11 aa, Artificial Sequence
  Description of Artificial Sequence: Synthetic peptide
PQQPFPQQPQQ

SEQ ID NO: 1416 - protein, 11 aa, Artificial Sequence
  Description of Artificial Sequence: Synthetic peptide
PQQPFPEQPQQ

SEQ ID NO: 1417 - protein, 11 aa, Artificial Sequence
  Description of Artificial Sequence: Synthetic peptide
PEQPFPEQPEQ

SEQ ID NO: 1418 - protein, 23 aa, Artificial Sequence
  Description of Artificial Sequence: Synthetic peptide
QQPFPQQPQQPYPQQPQQPFPQP

SEQ ID NO: 1419 - protein, 23 aa, Artificial Sequence
  Description of Artificial Sequence: Synthetic peptide
EQPFPEQPEQPYPEQPEQPFPQP

SEQ ID NO: 1420 - protein, 14 aa, Artificial Sequence
  Description of Artificial Sequence: Synthetic peptide
QQPFPQQPQQPYPQ

SEQ ID NO: 1421 - protein, 9 aa, Artificial Sequence
  Description of Artificial Sequence: Synthetic peptide
QQPFPQQPQ

SEQ ID NO: 1422 - protein, 9 aa, Artificial Sequence
  Description of Artificial Sequence: Synthetic peptide
QQPFPEQPQ

SEQ ID NO: 1423 - protein, 9 aa, Artificial Sequence
  Description of Artificial Sequence: Synthetic peptide
EQPFPEQPE

SEQ ID NO: 1424 - protein, 15 aa, Artificial Sequence
  Description of Artificial Sequence: Synthetic peptide
PFPQQPQQPYPQQPQ

SEQ ID NO: 1425 - protein, 15 aa, Artificial Sequence
  Description of Artificial Sequence: Synthetic peptide
PFPEQPQQPYPQQPQ

SEQ ID NO: 1426 - protein, 15 aa, Artificial Sequence
  Description of Artificial Sequence: Synthetic peptide
PFPQQPEQPYPQQPQ

SEQ ID NO: 1427 - protein, 15 aa, Artificial Sequence
  Description of Artificial Sequence: Synthetic peptide
PFPEQPEQPYPQQPQ

SEQ ID NO: 1428 - protein, 12 aa, Artificial Sequence
  Description of Artificial Sequence: Synthetic peptide
PFPQQPQQPYPQ

SEQ ID NO: 1429 - protein, 15 aa, Artificial Sequence
  Description of Artificial Sequence: Synthetic peptide
FPQQPQQPYPQQPQQ

SEQ ID NO: 1430 - protein, 15 aa, Artificial Sequence
  Description of Artificial Sequence: Synthetic peptide
FPEQPQQPYPQQPQQ

SEQ ID NO: 1431 - protein, 15 aa, Artificial Sequence
  Description of Artificial Sequence: Synthetic peptide
FPQQPEQPYPQQPQQ

SEQ ID NO: 1432 - protein, 15 aa, Artificial Sequence
  Description of Artificial Sequence: Synthetic peptide
FPQQPQQPYPEQPQQ

SEQ ID NO: 1433 - protein, 15 aa, Artificial Sequence
  Description of Artificial Sequence: Synthetic peptide
FPEQPQQPYPEQPQQ

SEQ ID NO: 1434 - protein, 13 aa, Artificial Sequence
  Description of Artificial Sequence: Synthetic peptide
FPQQPQQPYPQQP

SEQ ID NO: 1435 - protein, 13 aa, Artificial Sequence
  Description of Artificial Sequence: Synthetic peptide
FPEQPEQPYPQQP

SEQ ID NO: 1436 - protein, 13 aa, Artificial Sequence
  Description of Artificial Sequence: Synthetic peptide
FPEQPQEPYPQQP

SEQ ID NO: 1437 - protein, 12 aa, Artificial Sequence
  Description of Artificial Sequence: Synthetic peptide
FPQQPQQPYPQQ

SEQ ID NO: 1438 - protein, 12 aa, Artificial Sequence
  Description of Artificial Sequence: Synthetic peptide
FPQQPEQPYPQQ

SEQ ID NO: 1439 - protein, 12 aa, Artificial Sequence
  Description of Artificial Sequence: Synthetic peptide
FPEQPEQPYPEQ

SEQ ID NO: 1440 - protein, 11 aa, Artificial Sequence
  Description of Artificial Sequence: Synthetic peptide
PEQPEQPYPEQ

SEQ ID NO: 1441 - protein, 9 aa, Artificial Sequence
  Description of Artificial Sequence: Synthetic peptide
QQPQQPYPQ

SEQ ID NO: 1442 - protein, 9 aa, Artificial Sequence
  Description of Artificial Sequence: Synthetic peptide
EQPEQPYPE

SEQ ID NO: 1443 - protein, 9 aa, Artificial Sequence
  Description of Artificial Sequence: Synthetic peptide
EQPQQPYPE

SEQ ID NO: 1444 - protein, 9 aa, Artificial Sequence
  Description of Artificial Sequence: Synthetic peptide
EQPQQPFPE

SEQ ID NO: 1445 - protein, 9 aa, Artificial Sequence
  Description of Artificial Sequence: Synthetic peptide
QQPEQPYPQ

SEQ ID NO: 1446 - protein, 14 aa, Artificial Sequence
  Description of Artificial Sequence: Synthetic peptide
QQPYPQQPQQPFPQ

SEQ ID NO: 1447 - protein, 9 aa, Artificial Sequence
  Description of Artificial Sequence: Synthetic peptide
QQPYPQQPQ

SEQ ID NO: 1448 - protein, 9 aa, Artificial Sequence
  Description of Artificial Sequence: Synthetic peptide
EQPYPQQPQ

SEQ ID NO: 1449 - protein, 9 aa, Artificial Sequence
  Description of Artificial Sequence: Synthetic peptide
QQPYPEQPQ

SEQ ID NO: 1450 - protein, 9 aa, Artificial Sequence
  Description of Artificial Sequence: Synthetic peptide
EQPYPEQPQ

SEQ ID NO: 1451 - protein, 9 aa, Artificial Sequence
  Description of Artificial Sequence: Synthetic peptide
PYPQQPQQP

SEQ ID NO: 1452 - protein, 9 aa, Artificial Sequence
  Description of Artificial Sequence: Synthetic peptide
PYPEQPQQP

SEQ ID NO: 1453 - protein, 9 aa, Artificial Sequence
  Description of Artificial Sequence: Synthetic peptide
PYPQQPEQP

SEQ ID NO: 1454 - protein, 9 aa, Artificial Sequence
  Description of Artificial Sequence: Synthetic peptide
PYPEQPEQP

SEQ ID NO: 1455 - protein, 9 aa, Artificial Sequence
  Description of Artificial Sequence: Synthetic peptide
QQPQQPFPQ

SEQ ID NO: 1456 - protein, 9 aa, Artificial Sequence
  Description of Artificial Sequence: Synthetic peptide
EQPQQPFPQ

SEQ ID NO: 1457 - protein, 9 aa, Artificial Sequence
  Description of Artificial Sequence: Synthetic peptide
QQPEQPFPQ

SEQ ID NO: 1458 - protein, 9 aa, Artificial Sequence
  Description of Artificial Sequence: Synthetic peptide
EQPEQPFPQ

SEQ ID NO: 1459 - protein, 14 aa, Artificial Sequence
  Description of Artificial Sequence: Synthetic peptide
PQQQTLQPQQPAQL

SEQ ID NO: 1460 - protein, 14 aa, Artificial Sequence
  Description of Artificial Sequence: Synthetic peptide
PQQQTLQPEQPAQL

SEQ ID NO: 1461 - protein, 20 aa, Artificial Sequence
  Description of Artificial Sequence: Synthetic peptide
ATANMQVDPSGQVQWPQQQP

SEQ ID NO: 1462 - protein, 12 aa, Artificial Sequence
  Description of Artificial Sequence: Synthetic peptide
QVDPSGQVQWPQ

SEQ ID NO: 1463 - protein, 20 aa, Artificial Sequence
  Description of Artificial Sequence: Synthetic peptide
WPQQQPFPQPQQPFCQQPQR

SEQ ID NO: 1464 - protein, 20 aa, Artificial Sequence
  Description of Artificial Sequence: Synthetic peptide
QQPFCQQPQRTIPQPHQTFH

SEQ ID NO: 1465 - protein, 20 aa, Artificial Sequence
  Description of Artificial Sequence: Synthetic peptide
TIPQPHQTFHHQPQQTFPQP

SEQ ID NO: 1466 - protein, 20 aa, Artificial Sequence
  Description of Artificial Sequence: Synthetic peptide
HQPQQTFPQPQQTYPHQPQQ

SEQ ID NO: 1467 - protein, 20 aa, Artificial Sequence
  Description of Artificial Sequence: Synthetic peptide
QQTYPHQPQQQFPQTQQPQQ

SEQ ID NO: 1468 - protein, 20 aa, Artificial Sequence
  Description of Artificial Sequence: Synthetic peptide
QFPQTQQPQQPFPQPQQTFP

SEQ ID NO: 1469 - protein, 20 aa, Artificial Sequence
  Description of Artificial Sequence: Synthetic peptide
QFPETQQPQQPFPQPQQTFP

SEQ ID NO: 1470 - protein, 20 aa, Artificial Sequence
  Description of Artificial Sequence: Synthetic peptide
QFPQTEQPQQPFPQPQQTFP

SEQ ID NO: 1471 - protein, 20 aa, Artificial Sequence
  Description of Artificial Sequence: Synthetic peptide
QFPQTQQPEQPFPQPQQTFP

SEQ ID NO: 1472 - protein, 20 aa, Artificial Sequence
  Description of Artificial Sequence: Synthetic peptide
QFPQTQQPQQPFPQPEQTFP

SEQ ID NO: 1473 - protein, 20 aa, Artificial Sequence
  Description of Artificial Sequence: Synthetic peptide
QFPETEQPQQPFPQPQQTFP

SEQ ID NO: 1474 - protein, 20 aa, Artificial Sequence
  Description of Artificial Sequence: Synthetic peptide
QFPETQQPEQPFPQPQQTFP

SEQ ID NO: 1475 - protein, 20 aa, Artificial Sequence
  Description of Artificial Sequence: Synthetic peptide
QFPETQQPQQPFPQPEQTFP

SEQ ID NO: 1476 - protein, 20 aa, Artificial Sequence
  Description of Artificial Sequence: Synthetic peptide
QFPQTEQPEQPFPQPQQTFP

SEQ ID NO: 1477 - protein, 20 aa, Artificial Sequence
  Description of Artificial Sequence: Synthetic peptide
QFPQTEQPQQPFPQPEQTFP

SEQ ID NO: 1478 - protein, 20 aa, Artificial Sequence
  Description of Artificial Sequence: Synthetic peptide
QFPQTQQPEQPFPQPEQTFP

SEQ ID NO: 1479 - protein, 20 aa, Artificial Sequence
  Description of Artificial Sequence: Synthetic peptide
QFPETEQPEQPFPQPQQTFP

SEQ ID NO: 1480 - protein, 20 aa, Artificial Sequence
  Description of Artificial Sequence: Synthetic peptide
QFPETEQPQQPFPQPEQTFP

SEQ ID NO: 1481 - protein, 20 aa, Artificial Sequence
  Description of Artificial Sequence: Synthetic peptide
QFPETQQPEQPFPQPEQTFP

SEQ ID NO: 1482 - protein, 20 aa, Artificial Sequence
  Description of Artificial Sequence: Synthetic peptide
QFPQTEQPEQPFPQPEQTFP

SEQ ID NO: 1483 - protein, 20 aa, Artificial Sequence
  Description of Artificial Sequence: Synthetic peptide
QFPETEQPEQPFPQPEQTFP

SEQ ID NO: 1484 - protein, 20 aa, Artificial Sequence
  Description of Artificial Sequence: Synthetic peptide
PQQPFPQPQQTFPQQPQLPF

SEQ ID NO: 1485 - protein, 20 aa, Artificial Sequence
  Description of Artificial Sequence: Synthetic peptide
PFPQPQQTFPQQPQLPFPQQ

SEQ ID NO: 1486 - protein, 11 aa, Artificial Sequence
  Description of Artificial Sequence: Synthetic peptide
PFPQPQQTFPQ

SEQ ID NO: 1487 - protein, 12 aa, Artificial Sequence
  Description of Artificial Sequence: Synthetic peptide
PQQTFPQQPQLP

SEQ ID NO: 1488 - protein, 20 aa, Artificial Sequence
  Description of Artificial Sequence: Synthetic peptide
SQQPQQQFSQPQQQFPQPQQ

SEQ ID NO: 1489 - protein, 15 aa, Artificial Sequence
  Description of Artificial Sequence: Synthetic peptide
QQFSQPQQQFPQPQQ

SEQ ID NO: 1490 - protein, 15 aa, Artificial Sequence
  Description of Artificial Sequence: Synthetic peptide
QQFSQPEQQFPQPQQ

SEQ ID NO: 1491 - protein, 15 aa, Artificial Sequence
  Description of Artificial Sequence: Synthetic peptide
QQFSQPQQEFPQPQQ

SEQ ID NO: 1492 - protein, 15 aa, Artificial Sequence
  Description of Artificial Sequence: Synthetic peptide
QQFSQPEQEFPQPQQ

SEQ ID NO: 1493 - protein, 12 aa, Artificial Sequence
  Description of Artificial Sequence: Synthetic peptide
QQFSQPQQQFPQ

SEQ ID NO: 1494 - protein, 13 aa, Artificial Sequence
  Description of Artificial Sequence: Synthetic peptide
QFSQPQQQFPQPQ

SEQ ID NO: 1495 - protein, 12 aa, Artificial Sequence
  Description of Artificial Sequence: Synthetic peptide
FSQPQQQFPQPQ

SEQ ID NO: 1496 - protein, 12 aa, Artificial Sequence
  Description of Artificial Sequence: Synthetic peptide
FSQPEQQFPQPQ

SEQ ID NO: 1497 - protein, 12 aa, Artificial Sequence
  Description of Artificial Sequence: Synthetic peptide
FSQPQQEFPQPQ

SEQ ID NO: 1498 - protein, 12 aa, Artificial Sequence
  Description of Artificial Sequence: Synthetic peptide
FSQPEQEFPQPQ

SEQ ID NO: 1499 - protein, 10 aa, Artificial Sequence
  Description of Artificial Sequence: Synthetic peptide
FSQPQQQFPQ

SEQ ID NO: 1500 - protein, 10 aa, Artificial Sequence
  Description of Artificial Sequence: Synthetic peptide
FSQPEQQFPQ

SEQ ID NO: 1501 - protein, 10 aa, Artificial Sequence
  Description of Artificial Sequence: Synthetic peptide
FSQPQQEFPQ

SEQ ID NO: 1502 - protein, 10 aa, Artificial Sequence
  Description of Artificial Sequence: Synthetic peptide
FSQPEQEFPQ

SEQ ID NO: 1503 - protein, 12 aa, Artificial Sequence
  Description of Artificial Sequence: Synthetic peptide
SQPQQQFPQPQQ

SEQ ID NO: 1504 - protein, 9 aa, Artificial Sequence
  Description of Artificial Sequence: Synthetic peptide
SQPQQQFPQ

SEQ ID NO: 1505 - protein, 9 aa, Artificial Sequence
  Description of Artificial Sequence: Synthetic peptide
SQPEQEFPQ

SEQ ID NO: 1506 - protein, 11 aa, Artificial Sequence
  Description of Artificial Sequence: Synthetic peptide
QQPQQSFPQQQ

SEQ ID NO: 1507 - protein, 10 aa, Artificial Sequence
  Description of Artificial Sequence: Synthetic peptide
QPQQSFPQQQ

SEQ ID NO: 1508 - protein, 10 aa, Artificial Sequence
  Description of Artificial Sequence: Synthetic peptide
QPQQSFPEQQ

SEQ ID NO: 1509 - protein, 20 aa, Artificial Sequence
  Description of Artificial Sequence: Synthetic peptide
WPQQQPFPQPQQPFCQQPQQ

SEQ ID NO: 1510 - protein, 20 aa, Artificial Sequence
  Description of Artificial Sequence: Synthetic peptide
WPQQQPFPQPEQPFCQQPQQ

SEQ ID NO: 1511 - protein, 12 aa, Artificial Sequence
  Description of Artificial Sequence: Synthetic peptide
QPFPQPEQPFCQ

SEQ ID NO: 1512 - protein, 14 aa, Artificial Sequence
  Description of Artificial Sequence: Synthetic peptide
QFPQTQQPQQPFPQ

SEQ ID NO: 1513 - protein, 14 aa, Artificial Sequence
  Description of Artificial Sequence: Synthetic peptide
PQTEQPQQPFPQPQ

SEQ ID NO: 1514 - protein, 14 aa, Artificial Sequence
  Description of Artificial Sequence: Synthetic peptide
PQTQQPEQPFPQPQ

SEQ ID NO: 1515 - protein, 14 aa, Artificial Sequence
  Description of Artificial Sequence: Synthetic peptide
PQTEQPEQPFPQPQ

SEQ ID NO: 1516 - protein, 11 aa, Artificial Sequence
  Description of Artificial Sequence: Synthetic peptide
TQQPQQPFPQP

SEQ ID NO: 1517 - protein, 11 aa, Artificial Sequence
  Description of Artificial Sequence: Synthetic peptide
TEQPEQPFPQP

SEQ ID NO: 1518 - protein, 20 aa, Artificial Sequence
  Description of Artificial Sequence: Synthetic peptide
QQPQLPFPQQPQQPFPQPQQ

SEQ ID NO: 1519 - protein, 14 aa, Artificial Sequence
  Description of Artificial Sequence: Synthetic peptide
QLPFPQQPQQPFPQ

SEQ ID NO: 1520 - protein, 10 aa, Artificial Sequence
  Description of Artificial Sequence: Synthetic peptide
PFPQQPQQPF

SEQ ID NO: 1521 - protein, 10 aa, Artificial Sequence
  Description of Artificial Sequence: Synthetic peptide
PFPEQPQQPF

SEQ ID NO: 1522 - protein, 10 aa, Artificial Sequence
  Description of Artificial Sequence: Synthetic peptide
PFPQQPEQPF

SEQ ID NO: 1523 - protein, 10 aa, Artificial Sequence
  Description of Artificial Sequence: Synthetic peptide
PFPEQPEQPF

SEQ ID NO: 1524 - protein, 9 aa, Artificial Sequence
  Description of Artificial Sequence: Synthetic peptide
FPQQPQQPF

SEQ ID NO: 1525 - protein, 9 aa, Artificial Sequence
  Description of Artificial Sequence: Synthetic peptide
FPEQPQQPF

SEQ ID NO: 1526 - protein, 9 aa, Artificial Sequence
  Description of Artificial Sequence: Synthetic peptide
FPQQPQEPF

SEQ ID NO: 1527 - protein, 9 aa, Artificial Sequence
  Description of Artificial Sequence: Synthetic peptide
FPEQPQEPF

SEQ ID NO: 1528 - protein, 20 aa, Artificial Sequence
  Description of Artificial Sequence: Synthetic peptide
PQQPFPQPQQPQQPFPQSQQ

SEQ ID NO: 1529 - protein, 20 aa, Artificial Sequence
  Description of Artificial Sequence: Synthetic peptide
QQPAQYEVIRSLVLRTLPNM

SEQ ID NO: 1530 - protein, 16 aa, Artificial Sequence
  Description of Artificial Sequence: Synthetic peptide
QYEVIRSLVLRTLPNM

SEQ ID NO: 1531 - protein, 15 aa, Artificial Sequence
  Description of Artificial Sequence: Synthetic peptide
EYEVIRSLVLRTLPN

SEQ ID NO: 1532 - protein, 15 aa, Artificial Sequence
  Description of Artificial Sequence: Synthetic peptide
QYQVIRSLVLRTLPN

SEQ ID NO: 1533 - protein, 20 aa, Artificial Sequence
  Description of Artificial Sequence: Synthetic peptide
QQQFIQPQQPFPQQPQQTYP

SEQ ID NO: 1534 - protein, 12 aa, Artificial Sequence
  Description of Artificial Sequence: Synthetic peptide
QQFIQPQQPFPQ

SEQ ID NO: 1535 - protein, 14 aa, Artificial Sequence
  Description of Artificial Sequence: Synthetic peptide
PFPQTQQPQQPFPQ

SEQ ID NO: 1536 - protein, 20 aa, Artificial Sequence
  Description of Artificial Sequence: Synthetic peptide
PQQPFPQSQQPQQPFPQPQQ

SEQ ID NO: 1537 - protein, 14 aa, Artificial Sequence
  Description of Artificial Sequence: Synthetic peptide
PFPQSQQPQQPFPQ

SEQ ID NO: 1538 - protein, 20 aa, Artificial Sequence
  Description of Artificial Sequence: Synthetic peptide
SQQPQQPFPQPQQQFPQPQQ

SEQ ID NO: 1539 - protein, 20 aa, Artificial Sequence
  Description of Artificial Sequence: Synthetic peptide
PQQPFPQPQQQFPQPQQPQQ

SEQ ID NO: 1540 - protein, 20 aa, Artificial Sequence
  Description of Artificial Sequence: Synthetic peptide
PEQPFPQPQQQFPQPQQPQQ

SEQ ID NO: 1541 - protein, 20 aa, Artificial Sequence
  Description of Artificial Sequence: Synthetic peptide
PQQPFPQPEQQFPQPQQPQQ

SEQ ID NO: 1542 - protein, 20 aa, Artificial Sequence
  Description of Artificial Sequence: Synthetic peptide
PQQPFPQPQQEFPQPQQPQQ

SEQ ID NO: 1543 - protein, 20 aa, Artificial Sequence
  Description of Artificial Sequence: Synthetic peptide
PQQPFPQPQQQFPQPEQPQQ

SEQ ID NO: 1544 - protein, 20 aa, Artificial Sequence
  Description of Artificial Sequence: Synthetic peptide
PEQPFPQPEQQFPQPQQPQQ

SEQ ID NO: 1545 - protein, 20 aa, Artificial Sequence
  Description of Artificial Sequence: Synthetic peptide
PEQPFPQPQQEFPQPQQPQQ

SEQ ID NO: 1546 - protein, 20 aa, Artificial Sequence
  Description of Artificial Sequence: Synthetic peptide
PEQPFPQPQQQFPQPEQPQQ

SEQ ID NO: 1547 - protein, 20 aa, Artificial Sequence
  Description of Artificial Sequence: Synthetic peptide
PQQPFPQPEQEFPQPQQPQQ

SEQ ID NO: 1548 - protein, 20 aa, Artificial Sequence
  Description of Artificial Sequence: Synthetic peptide
PQQPFPQPEQQFPQPEQPQQ

SEQ ID NO: 1549 - protein, 20 aa, Artificial Sequence
  Description of Artificial Sequence: Synthetic peptide
PQQPFPQPQQEFPQPEQPQQ

SEQ ID NO: 1550 - protein, 20 aa, Artificial Sequence
  Description of Artificial Sequence: Synthetic peptide
PEQPFPQPEQEFPQPQQPQQ

SEQ ID NO: 1551 - protein, 20 aa, Artificial Sequence
  Description of Artificial Sequence: Synthetic peptide
PEQPFPQPEQQFPQPEQPQQ

SEQ ID NO: 1552 - protein, 20 aa, Artificial Sequence
  Description of Artificial Sequence: Synthetic peptide
PEQPFPQPQQEFPQPEQPQQ

SEQ ID NO: 1553 - protein, 20 aa, Artificial Sequence
  Description of Artificial Sequence: Synthetic peptide
PQQPFPQPEQEFPQPEQPQQ

SEQ ID NO: 1554 - protein, 20 aa, Artificial Sequence
  Description of Artificial Sequence: Synthetic peptide
PEQPFPQPEQEFPQPEQPQQ

SEQ ID NO: 1555 - protein, 12 aa, Artificial Sequence
  Description of Artificial Sequence: Synthetic peptide
FPQPQQQFPQPQ

SEQ ID NO: 1556 - protein, 12 aa, Artificial Sequence
  Description of Artificial Sequence: Synthetic peptide
FPQPEQQFPQPQ

SEQ ID NO: 1557 - protein, 12 aa, Artificial Sequence
  Description of Artificial Sequence: Synthetic peptide
FPQPQQEFPQPQ

SEQ ID NO: 1558 - protein, 12 aa, Artificial Sequence
  Description of Artificial Sequence: Synthetic peptide
FPQPEQEFPQPQ

SEQ ID NO: 1559 - protein, 9 aa, Artificial Sequence
  Description of Artificial Sequence: Synthetic peptide
PQPQQQFPQ

SEQ ID NO: 1560 - protein, 9 aa, Artificial Sequence
  Description of Artificial Sequence: Synthetic peptide
PQPEQQFPQ

SEQ ID NO: 1561 - protein, 9 aa, Artificial Sequence
  Description of Artificial Sequence: Synthetic peptide
PQPQQEFPQ

SEQ ID NO: 1562 - protein, 9 aa, Artificial Sequence
  Description of Artificial Sequence: Synthetic peptide
PQPEQEFPQ

SEQ ID NO: 1563 - protein, 16 aa, Artificial Sequence
  Description of Artificial Sequence: Synthetic peptide
GQQPFPQPEQEFPQPG

SEQ ID NO: 1564 - protein, 13 aa, Artificial Sequence
  Description of Artificial Sequence: Synthetic peptide
QPFPQPEQEFPQP

SEQ ID NO: 1565 - protein, 9 aa, Artificial Sequence
  Description of Artificial Sequence: Synthetic peptide
PQQSFPQQQ

SEQ ID NO: 1566 - protein, 9 aa, Artificial Sequence
  Description of Artificial Sequence: Synthetic peptide
PQQSFPQQE

SEQ ID NO: 1567 - protein, 9 aa, Artificial Sequence
  Description of Artificial Sequence: Synthetic peptide
PQQSFPEQE

SEQ ID NO: 1568 - protein, 9 aa, Artificial Sequence
  Description of Artificial Sequence: Synthetic peptide
PQQSFPEQQ

SEQ ID NO: 1569 - protein, 15 aa, Artificial Sequence
  Description of Artificial Sequence: Synthetic peptide
VQGQGIIQPQQPAQL

SEQ ID NO: 1570 - protein, 15 aa, Artificial Sequence
  Description of Artificial Sequence: Synthetic peptide
VQGEGIIQPQQPAQL

SEQ ID NO: 1571 - protein, 15 aa, Artificial Sequence
  Description of Artificial Sequence: Synthetic peptide
VQGQGIIQPEQPAQL

SEQ ID NO: 1572 - protein, 15 aa, Artificial Sequence
  Description of Artificial Sequence: Synthetic peptide
VQGEGIIQPEQPAQL

SEQ ID NO: 1573 - protein, 15 aa, Artificial Sequence
  Description of Artificial Sequence: Synthetic peptide
GQGIIQPQQPAQLIR

SEQ ID NO: 1574 - protein, 15 aa, Artificial Sequence
  Description of Artificial Sequence: Synthetic peptide
GQGIIQPEQPAQLIR

SEQ ID NO: 1575 - protein, 11 aa, Artificial Sequence
  Description of Artificial Sequence: Synthetic peptide
GIIQPQQPAQL

SEQ ID NO: 1576 - protein, 11 aa, Artificial Sequence
  Description of Artificial Sequence: Synthetic peptide
GIIQPEQPAQL

SEQ ID NO: 1577 - protein, 10 aa, Artificial Sequence
  Description of Artificial Sequence: Synthetic peptide
IIQPQQPAQL

SEQ ID NO: 1578 - protein, 10 aa, Artificial Sequence
  Description of Artificial Sequence: Synthetic peptide
IIQPEQPAQL

SEQ ID NO: 1579 - protein, 9 aa, Artificial Sequence
  Description of Artificial Sequence: Synthetic peptide
IIQPQQPAQ

SEQ ID NO: 1580 - protein, 9 aa, Artificial Sequence
  Description of Artificial Sequence: Synthetic peptide
IIQPEQPAQ

SEQ ID NO: 1581 - protein, 9 aa, Artificial Sequence
  Description of Artificial Sequence: Synthetic peptide
IQPQQPAQL

SEQ ID NO: 1582 - protein, 9 aa, Artificial Sequence
  Description of Artificial Sequence: Synthetic peptide
IQPEQPAQL

SEQ ID NO: 1583 - protein, 20 aa, Artificial Sequence
  Description of Artificial Sequence: Synthetic peptide
QFPQPQQPQQSFPQQQQPAI

SEQ ID NO: 1584 - protein, 15 aa, Artificial Sequence
  Description of Artificial Sequence: Synthetic peptide
PQQPQQSFPQQQQPA

SEQ ID NO: 1585 - protein, 15 aa, Artificial Sequence
  Description of Artificial Sequence: Synthetic peptide
PQQPQQSFPEQQQPA

SEQ ID NO: 1586 - protein, 15 aa, Artificial Sequence
  Description of Artificial Sequence: Synthetic peptide
PQQPQQSFPQQEQPA

SEQ ID NO: 1587 - protein, 15 aa, Artificial Sequence
  Description of Artificial Sequence: Synthetic peptide
PQQPQQSFPEQEQPA

SEQ ID NO: 1588 - protein, 20 aa, Artificial Sequence
  Description of Artificial Sequence: Synthetic peptide
SFPQQQQPAIQSFLQQQMNP

SEQ ID NO: 1589 - protein, 20 aa, Artificial Sequence
  Description of Artificial Sequence: Synthetic peptide
QSFLQQQMNPCKNFLLQQCN

SEQ ID NO: 1590 - protein, 20 aa, Artificial Sequence
  Description of Artificial Sequence: Synthetic peptide
IHSVAHSIIMQQEQQQGVPI

SEQ ID NO: 1591 - protein, 20 aa, Artificial Sequence
  Description of Artificial Sequence: Synthetic peptide
LRPLFQLAQGLGIIQPQQPA

SEQ ID NO: 1592 - protein, 20 aa, Artificial Sequence
  Description of Artificial Sequence: Synthetic peptide
LGIIQPQQPAQLEGIRSLVL

SEQ ID NO: 1593 - protein, 18 aa, Artificial Sequence
  Description of Artificial Sequence: Synthetic peptide
PHQPQQQVPQPQQPQQPF

SEQ ID NO: 1594 - protein, 14 aa, Artificial Sequence
  Description of Artificial Sequence: Synthetic peptide
QQPFPQQPQQPFPQ

SEQ ID NO: 1595 - protein, 14 aa, Artificial Sequence
  Description of Artificial Sequence: Synthetic peptide
QQPFPEQPEQPFPQ

SEQ ID NO: 1596 - protein, 14 aa, Artificial Sequence
  Description of Artificial Sequence: Synthetic peptide
QQPFPQQPEQPFPQ

SEQ ID NO: 1597 - protein, 14 aa, Artificial Sequence
  Description of Artificial Sequence: Synthetic peptide
QQPFPEQPQQPFPQ

SEQ ID NO: 1598 - protein, 20 aa, Artificial Sequence
  Description of Artificial Sequence: Synthetic peptide
QTQQPQQPFPQQPQQPFPQT

SEQ ID NO: 1599 - protein, 14 aa, Artificial Sequence
  Description of Artificial Sequence: Synthetic peptide
PFPQLQQPQQPFPQ

SEQ ID NO: 1600 - protein, 21 aa, Artificial Sequence
  Description of Artificial Sequence: Synthetic peptide
YQQLPQPQQPQQSFPQQQRPF

SEQ ID NO: 1601 - protein, 20 aa, Artificial Sequence
  Description of Artificial Sequence: Synthetic peptide
QQLPQPQQPQQSFPQQQRPF

SEQ ID NO: 1602 - protein, 17 aa, Artificial Sequence
  Description of Artificial Sequence: Synthetic peptide
QPQQPQQSFPQQQRPFI

SEQ ID NO: 1603 - protein, 16 aa, Artificial Sequence
  Description of Artificial Sequence: Synthetic peptide
QPQQPQQSFPQQQRPF

SEQ ID NO: 1604 - protein, 15 aa, Artificial Sequence
  Description of Artificial Sequence: Synthetic peptide
PQQPQQSFPQQQRPF

SEQ ID NO: 1605 - protein, 15 aa, Artificial Sequence
  Description of Artificial Sequence: Synthetic peptide
PQQPQQSFPEQQRPF

SEQ ID NO: 1606 - protein, 15 aa, Artificial Sequence
  Description of Artificial Sequence: Synthetic peptide
PEQPQQSFPEQQRPF

SEQ ID NO: 1607 - protein, 15 aa, Artificial Sequence
  Description of Artificial Sequence: Synthetic peptide
PQQPQQSFPEQERPF

SEQ ID NO: 1608 - protein, 15 aa, Artificial Sequence
  Description of Artificial Sequence: Synthetic peptide
PEQPQQSFPEQERPF

SEQ ID NO: 1609 - protein, 14 aa, Artificial Sequence
  Description of Artificial Sequence: Synthetic peptide
PQQPQQSFPQQQRP

SEQ ID NO: 1610 - protein, 14 aa, Artificial Sequence
  Description of Artificial Sequence: Synthetic peptide
PEQPQQSFPEQERP

SEQ ID NO: 1611 - protein, 14 aa, Artificial Sequence
  Description of Artificial Sequence: Synthetic peptide
PQQPQQSFPEQQRP

SEQ ID NO: 1612 - protein, 14 aa, Artificial Sequence
  Description of Artificial Sequence: Synthetic peptide
PEQPQQSFPEQQRP

SEQ ID NO: 1613 - protein, 14 aa, Artificial Sequence
  Description of Artificial Sequence: Synthetic peptide
KEQPQQSFPEQERP

SEQ ID NO: 1614 - protein, 14 aa, Artificial Sequence
  Description of Artificial Sequence: Synthetic peptide
PKQPQQSFPEQERP

SEQ ID NO: 1615 - protein, 14 aa, Artificial Sequence
  Description of Artificial Sequence: Synthetic peptide
PEKPQQSFPEQERP

SEQ ID NO: 1616 - protein, 14 aa, Artificial Sequence
  Description of Artificial Sequence: Synthetic peptide
PEQKQQSFPEQERP

SEQ ID NO: 1617 - protein, 14 aa, Artificial Sequence
  Description of Artificial Sequence: Synthetic peptide
PEQPKQSFPEQERP

SEQ ID NO: 1618 - protein, 14 aa, Artificial Sequence
  Description of Artificial Sequence: Synthetic peptide
PEQPQQKFPEQERP

SEQ ID NO: 1619 - protein, 14 aa, Artificial Sequence
  Description of Artificial Sequence: Synthetic peptide
PEQPQQSFPEQKRP

SEQ ID NO: 1620 - protein, 14 aa, Artificial Sequence
  Description of Artificial Sequence: Synthetic peptide
PEQPQQSFPEQEKP

SEQ ID NO: 1621 - protein, 14 aa, Artificial Sequence
  Description of Artificial Sequence: Synthetic peptide
PEQPQQSFPEQERK

SEQ ID NO: 1622 - protein, 12 aa, Artificial Sequence
  Description of Artificial Sequence: Synthetic peptide
QPQQSFPQQQRP

SEQ ID NO: 1623 - protein, 12 aa, Artificial Sequence
  Description of Artificial Sequence: Synthetic peptide
QPQQSFPEQQRP

SEQ ID NO: 1624 - protein, 16 aa, Artificial Sequence
  Description of Artificial Sequence: Synthetic peptide
QQSFPQQQRPFIQPSL

SEQ ID NO: 1625 - protein, 20 aa, Artificial Sequence
  Description of Artificial Sequence: Synthetic peptide
PQPQQPQLPFPQQPQQPFPQ

SEQ ID NO: 1626 - protein, 14 aa, Artificial Sequence
  Description of Artificial Sequence: Synthetic peptide
PFPQPQQPQQPFPQ

SEQ ID NO: 1627 - protein, 20 aa, Artificial Sequence
  Description of Artificial Sequence: Synthetic peptide
QQPLPQPQQPQQPFPQSQQP

SEQ ID NO: 1628 - protein, 20 aa, Artificial Sequence
  Description of Artificial Sequence: Synthetic peptide
QPQQPQQPFPQQQQPLIQPY

SEQ ID NO: 1629 - protein, 20 aa, Artificial Sequence
  Description of Artificial Sequence: Synthetic peptide
PQQPFPQQPQQQFPQPQQPQ

SEQ ID NO: 1630 - protein, 12 aa, Artificial Sequence
  Description of Artificial Sequence: Synthetic peptide
PFPQQPQQQFPQ

SEQ ID NO: 1631 - protein, 20 aa, Artificial Sequence
  Description of Artificial Sequence: Synthetic peptide
QPFPQLQQPQQPLPQPQQPQ

SEQ ID NO: 1632 - protein, 12 aa, Artificial Sequence
  Description of Artificial Sequence: Synthetic peptide
QPFPQLQQPQQP

SEQ ID NO: 1633 - protein, 20 aa, Artificial Sequence
  Description of Artificial Sequence: Synthetic peptide
SHIPGLERPWQQQPLPPQQT

SEQ ID NO: 1634 - protein, 15 aa, Artificial Sequence
  Description of Artificial Sequence: Synthetic peptide
QGLERPWQQQPLPPQ

SEQ ID NO: 1635 - protein, 15 aa, Artificial Sequence
  Description of Artificial Sequence: Synthetic peptide
EGLERPWQEQPLPPQ

SEQ ID NO: 1636 - protein, 12 aa, Artificial Sequence
  Description of Artificial Sequence: Synthetic peptide
LERPWQQQPLPP

SEQ ID NO: 1637 - protein, 16 aa, Artificial Sequence
  Description of Artificial Sequence: Synthetic peptide
GQQAFPQPEQTFPHQG

SEQ ID NO: 1638 - protein, 15 aa, Artificial Sequence
  Description of Artificial Sequence: Synthetic peptide
QQAFPQPQQTFPHQP

SEQ ID NO: 1639 - protein, 15 aa, Artificial Sequence
  Description of Artificial Sequence: Synthetic peptide
EQAFPQPEQTFPHQP

SEQ ID NO: 1640 - protein, 20 aa, Artificial Sequence
  Description of Artificial Sequence: Synthetic peptide
QAFPQPQQTFPHQPQQQFPQ

SEQ ID NO: 1641 - protein, 12 aa, Artificial Sequence
  Description of Artificial Sequence: Synthetic peptide
QAFPQPQQTFPH

SEQ ID NO: 1642 - protein, 12 aa, Artificial Sequence
  Description of Artificial Sequence: Synthetic peptide
QAFPQPEQTFPH

SEQ ID NO: 1643 - protein, 15 aa, Artificial Sequence
  Description of Artificial Sequence: Synthetic peptide
QQPPFSQQQQQPLPQ

SEQ ID NO: 1644 - protein, 15 aa, Artificial Sequence
  Description of Artificial Sequence: Synthetic peptide
QQPPFSEQQQQPLPQ

SEQ ID NO: 1645 - protein, 15 aa, Artificial Sequence
  Description of Artificial Sequence: Synthetic peptide
QQPPFSQEQQQPLPQ

SEQ ID NO: 1646 - protein, 15 aa, Artificial Sequence
  Description of Artificial Sequence: Synthetic peptide
QQPPFSQQQEQPLPQ

SEQ ID NO: 1647 - protein, 15 aa, Artificial Sequence
  Description of Artificial Sequence: Synthetic peptide
QQPPFSQQQQEPLPQ

SEQ ID NO: 1648 - protein, 15 aa, Artificial Sequence
  Description of Artificial Sequence: Synthetic peptide
QQPPFSEEQQQPLPQ

SEQ ID NO: 1649 - protein, 15 aa, Artificial Sequence
  Description of Artificial Sequence: Synthetic peptide
QQPPFSEQQEQPLPQ

SEQ ID NO: 1650 - protein, 15 aa, Artificial Sequence
  Description of Artificial Sequence: Synthetic peptide
QQPPFSEQQQEPLPQ

SEQ ID NO: 1651 - protein, 15 aa, Artificial Sequence
  Description of Artificial Sequence: Synthetic peptide
QQPPFSQEQEQPLPQ

SEQ ID NO: 1652 - protein, 15 aa, Artificial Sequence
  Description of Artificial Sequence: Synthetic peptide
QQPPFSQEQQEPLPQ

SEQ ID NO: 1653 - protein, 15 aa, Artificial Sequence
  Description of Artificial Sequence: Synthetic peptide
QQPPFSQQQEEPLPQ

SEQ ID NO: 1654 - protein, 15 aa, Artificial Sequence
  Description of Artificial Sequence: Synthetic peptide
QQPPFSEEQEQPLPQ

SEQ ID NO: 1655 - protein, 15 aa, Artificial Sequence
  Description of Artificial Sequence: Synthetic peptide
QQPPFSEEQQEPLPQ

SEQ ID NO: 1656 - protein, 15 aa, Artificial Sequence
  Description of Artificial Sequence: Synthetic peptide
QQPPFSQEQEEPLPQ

SEQ ID NO: 1657 - protein, 15 aa, Artificial Sequence
  Description of Artificial Sequence: Synthetic peptide
QQPPFSEQQEEPLPQ

SEQ ID NO: 1658 - protein, 15 aa, Artificial Sequence
  Description of Artificial Sequence: Synthetic peptide
QQPPFSEEQEEPLPQ

SEQ ID NO: 1659 - protein, 9 aa, Artificial Sequence
  Description of Artificial Sequence: Synthetic peptide
FSQQQQQPL

SEQ ID NO: 1660 - protein, 9 aa, Artificial Sequence
  Description of Artificial Sequence: Synthetic peptide
FSEQQQQPL

SEQ ID NO: 1661 - protein, 9 aa, Artificial Sequence
  Description of Artificial Sequence: Synthetic peptide
FSQEQQQPL

SEQ ID NO: 1662 - protein, 9 aa, Artificial Sequence
  Description of Artificial Sequence: Synthetic peptide
FSQQQEQPL

SEQ ID NO: 1663 - protein, 9 aa, Artificial Sequence
  Description of Artificial Sequence: Synthetic peptide
FSEEQQQPL

SEQ ID NO: 1664 - protein, 9 aa, Artificial Sequence
  Description of Artificial Sequence: Synthetic peptide
FSEQQEQPL

SEQ ID NO: 1665 - protein, 9 aa, Artificial Sequence
  Description of Artificial Sequence: Synthetic peptide
FSQEQEQPL

SEQ ID NO: 1666 - protein, 9 aa, Artificial Sequence
  Description of Artificial Sequence: Synthetic peptide
FSEEQQEPL

SEQ ID NO: 1667 - protein, 15 aa, Artificial Sequence
  Description of Artificial Sequence: Synthetic peptide
QQPPFSQQQQPVLPQ

SEQ ID NO: 1668 - protein, 15 aa, Artificial Sequence
  Description of Artificial Sequence: Synthetic peptide
QQPPFSEQQQPVLPQ

SEQ ID NO: 1669 - protein, 15 aa, Artificial Sequence
  Description of Artificial Sequence: Synthetic peptide
QQPPFSQQEQPVLPQ

SEQ ID NO: 1670 - protein, 15 aa, Artificial Sequence
  Description of Artificial Sequence: Synthetic peptide
QQPPFSEQEQPVLPQ

SEQ ID NO: 1671 - protein, 15 aa, Artificial Sequence
  Description of Artificial Sequence: Synthetic peptide
EQPPFSEQEQPVLPQ

SEQ ID NO: 1672 - protein, 9 aa, Artificial Sequence
  Description of Artificial Sequence: Synthetic peptide
PFSQQQQPV

SEQ ID NO: 1673 - protein, 9 aa, Artificial Sequence
  Description of Artificial Sequence: Synthetic peptide
PFSEQQQPV

SEQ ID NO: 1674 - protein, 9 aa, Artificial Sequence
  Description of Artificial Sequence: Synthetic peptide
PFSQQEQPV

SEQ ID NO: 1675 - protein, 9 aa, Artificial Sequence
  Description of Artificial Sequence: Synthetic peptide
PFSEQEQPV

SEQ ID NO: 1676 - protein, 20 aa, Artificial Sequence
  Description of Artificial Sequence: Synthetic peptide
CKVFLQQQCSPVAMPQRLAR

SEQ ID NO: 1677 - protein, 16 aa, Artificial Sequence
  Description of Artificial Sequence: Synthetic peptide
LQQQCSPVAMPQRLAR

SEQ ID NO: 1678 - protein, 20 aa, Artificial Sequence
  Description of Artificial Sequence: Synthetic peptide
PQQQQPFPQPQQPFSQQPQQ

SEQ ID NO: 1679 - protein, 20 aa, Artificial Sequence
  Description of Artificial Sequence: Synthetic peptide
PQQQQPFPQPEQPFSQQPQQ

SEQ ID NO: 1680 - protein, 12 aa, Artificial Sequence
  Description of Artificial Sequence: Synthetic peptide
QPFPQPQQPFSQ

SEQ ID NO: 1681 - protein, 12 aa, Artificial Sequence
  Description of Artificial Sequence: Synthetic peptide
QPFPQPEQPFSQ

SEQ ID NO: 1682 - protein, 20 aa, Artificial Sequence
  Description of Artificial Sequence: Synthetic peptide
QQPFPQPQQPQLPFPQQPQQ

SEQ ID NO: 1683 - protein, 15 aa, Artificial Sequence
  Description of Artificial Sequence: Synthetic peptide
QPFPQPQQPQLPFPQ

SEQ ID NO: 1684 - protein, 15 aa, Artificial Sequence
  Description of Artificial Sequence: Synthetic peptide
EPFPQPEQPELPFPQ

SEQ ID NO: 1685 - protein, 12 aa, Artificial Sequence
  Description of Artificial Sequence: Synthetic peptide
QPFPQPQQPQLP

SEQ ID NO: 1686 - protein, 15 aa, Artificial Sequence
  Description of Artificial Sequence: Synthetic peptide
QQPPFSQQQQPPFSQ

SEQ ID NO: 1687 - protein, 20 aa, Artificial Sequence
  Description of Artificial Sequence: Synthetic peptide
QQQQPPFSQQQQSPFSQQQQ

SEQ ID NO: 1688 - protein, 20 aa, Artificial Sequence
  Description of Artificial Sequence: Synthetic peptide
QQQQPPFSEQQQSPFSQQQQ

SEQ ID NO: 1689 - protein, 20 aa, Artificial Sequence
  Description of Artificial Sequence: Synthetic peptide
QQQQPPFSQQQESPFSQQQQ

SEQ ID NO: 1690 - protein, 20 aa, Artificial Sequence
  Description of Artificial Sequence: Synthetic peptide
QQQQPPFSEQQESPFSQQQQ

SEQ ID NO: 1691 - protein, 15 aa, Artificial Sequence
  Description of Artificial Sequence: Synthetic peptide
QQQQPPFSEEQESPY

SEQ ID NO: 1692 - protein, 15 aa, Artificial Sequence
  Description of Artificial Sequence: Synthetic peptide
QQQQPPFSEEQESPL

SEQ ID NO: 1693 - protein, 15 aa, Artificial Sequence
  Description of Artificial Sequence: Synthetic peptide
QQQQPPFSEEQESPF

SEQ ID NO: 1694 - protein, 15 aa, Artificial Sequence
  Description of Artificial Sequence: Synthetic peptide
QQQPPFSEEQESPFS

SEQ ID NO: 1695 - protein, 15 aa, Artificial Sequence
  Description of Artificial Sequence: Synthetic peptide
QQPPFSQQQQSPFSQ

SEQ ID NO: 1696 - protein, 15 aa, Artificial Sequence
  Description of Artificial Sequence: Synthetic peptide
QQPPFSEEQESPFSQ

SEQ ID NO: 1697 - protein, 12 aa, Artificial Sequence
  Description of Artificial Sequence: Synthetic peptide
QQPPFSQQQQSP

SEQ ID NO: 1698 - protein, 15 aa, Artificial Sequence
  Description of Artificial Sequence: Synthetic peptide
QPPFSEEQESPFSQQ

SEQ ID NO: 1699 - protein, 14 aa, Artificial Sequence
  Description of Artificial Sequence: Synthetic peptide
QPPFSQQQQSPFSQ

SEQ ID NO: 1700 - protein, 15 aa, Artificial Sequence
  Description of Artificial Sequence: Synthetic peptide
PPFSQQQQSPFSQQQ

SEQ ID NO: 1701 - protein, 15 aa, Artificial Sequence
  Description of Artificial Sequence: Synthetic peptide
PPFSEEQESPFSQQQ

SEQ ID NO: 1702 - protein, 15 aa, Artificial Sequence
  Description of Artificial Sequence: Synthetic peptide
PFSQQQQSPFSQQQQ

SEQ ID NO: 1703 - protein, 15 aa, Artificial Sequence
  Description of Artificial Sequence: Synthetic peptide
PFSEEQESPFSQQQQ

SEQ ID NO: 1704 - protein, 10 aa, Artificial Sequence
  Description of Artificial Sequence: Synthetic peptide
PFSQQQQSPF

SEQ ID NO: 1705 - protein, 10 aa, Artificial Sequence
  Description of Artificial Sequence: Synthetic peptide
PFSEQQQSPF

SEQ ID NO: 1706 - protein, 10 aa, Artificial Sequence
  Description of Artificial Sequence: Synthetic peptide
PFSQEQQSPF

SEQ ID NO: 1707 - protein, 10 aa, Artificial Sequence
  Description of Artificial Sequence: Synthetic peptide
PFSQQQESPF

SEQ ID NO: 1708 - protein, 10 aa, Artificial Sequence
  Description of Artificial Sequence: Synthetic peptide
PFSEQQESPF

SEQ ID NO: 1709 - protein, 10 aa, Artificial Sequence
  Description of Artificial Sequence: Synthetic peptide
PFSEEQQSPF

SEQ ID NO: 1710 - protein, 10 aa, Artificial Sequence
  Description of Artificial Sequence: Synthetic peptide
PFSQEQESPF

SEQ ID NO: 1711 - protein, 10 aa, Artificial Sequence
  Description of Artificial Sequence: Synthetic peptide
PFSEEQESPF

SEQ ID NO: 1712 - protein, 9 aa, Artificial Sequence
  Description of Artificial Sequence: Synthetic peptide
FSQQQQSPF

SEQ ID NO: 1713 - protein, 9 aa, Artificial Sequence
  Description of Artificial Sequence: Synthetic peptide
FSEQQQSPF

SEQ ID NO: 1714 - protein, 9 aa, Artificial Sequence
  Description of Artificial Sequence: Synthetic peptide
FSQQQESPF

SEQ ID NO: 1715 - protein, 9 aa, Artificial Sequence
  Description of Artificial Sequence: Synthetic peptide
FSEQQESPF

SEQ ID NO: 1716 - protein, 15 aa, Artificial Sequence
  Description of Artificial Sequence: Synthetic peptide
QQPPFSQQQQPQFSQ

SEQ ID NO: 1717 - protein, 19 aa, Artificial Sequence
  Description of Artificial Sequence: Synthetic peptide
SHQQQPFPQQPYPQQPYPS

SEQ ID NO: 1718 - protein, 14 aa, Artificial Sequence
  Description of Artificial Sequence: Synthetic peptide
PQQPFPSQQQQPLI

SEQ ID NO: 1719 - protein, 14 aa, Artificial Sequence
  Description of Artificial Sequence: Synthetic peptide
PQQPFPSQQEQPLI

SEQ ID NO: 1720 - protein, 15 aa, Artificial Sequence
  Description of Artificial Sequence: Synthetic peptide
QQPPFSQQQQPILPQ

SEQ ID NO: 1721 - protein, 14 aa, Artificial Sequence
  Description of Artificial Sequence: Synthetic peptide
QPPFSQQQQPILPQ

SEQ ID NO: 1722 - protein, 14 aa, Artificial Sequence
  Description of Artificial Sequence: Synthetic peptide
QPPFSEQEQPILPQ

SEQ ID NO: 1723 - protein, 15 aa, Artificial Sequence
  Description of Artificial Sequence: Synthetic peptide
QQPPFSQQQQQPILL

SEQ ID NO: 1724 - protein, 14 aa, Artificial Sequence
  Description of Artificial Sequence: Synthetic peptide
QPPFSQQQQQPILL

SEQ ID NO: 1725 - protein, 14 aa, Artificial Sequence
  Description of Artificial Sequence: Synthetic peptide
QPPFSEEQEQPILL

SEQ ID NO: 1726 - protein, 20 aa, Artificial Sequence
  Description of Artificial Sequence: Synthetic peptide
QGQQGYYPISPQQSGQGQQP

SEQ ID NO: 1727 - protein, 16 aa, Artificial Sequence
  Description of Artificial Sequence: Synthetic peptide
QGQQGYYPISPQQSGQ

SEQ ID NO: 1728 - protein, 16 aa, Artificial Sequence
  Description of Artificial Sequence: Synthetic peptide
EGQQGYYPISPQQSGQ

SEQ ID NO: 1729 - protein, 15 aa, Artificial Sequence
  Description of Artificial Sequence: Synthetic peptide
GQAGYYPTSPQQSGQ

SEQ ID NO: 1730 - protein, 15 aa, Artificial Sequence
  Description of Artificial Sequence: Synthetic peptide
GQQGYYPTSPQQPGQ

SEQ ID NO: 1731 - protein, 15 aa, Artificial Sequence
  Description of Artificial Sequence: Synthetic peptide
GQQGYYPISPQQSGQ

SEQ ID NO: 1732 - protein, 20 aa, Artificial Sequence
  Description of Artificial Sequence: Synthetic peptide
GQGQSGYYPTSPQQSGQEAT

SEQ ID NO: 1733 - protein, 16 aa, Artificial Sequence
  Description of Artificial Sequence: Synthetic peptide
GQGQSGYYPTSPQQSG

SEQ ID NO: 1734 - protein, 20 aa, Artificial Sequence
  Description of Artificial Sequence: Synthetic peptide
PGQGQSGYYPTSPQQSGQKQ

SEQ ID NO: 1735 - protein, 16 aa, Artificial Sequence
  Description of Artificial Sequence: Synthetic peptide
PGQGQSGYYPTSPQQS

SEQ ID NO: 1736 - protein, 15 aa, Artificial Sequence
  Description of Artificial Sequence: Synthetic peptide
GQSGYYPTSPQQSGQ

SEQ ID NO: 1737 - protein, 15 aa, Artificial Sequence
  Description of Artificial Sequence: Synthetic peptide
GQQGYYPISPQQLGQ

SEQ ID NO: 1738 - protein, 15 aa, Artificial Sequence
  Description of Artificial Sequence: Synthetic peptide
GQLGYYPTSPQQSGQ

SEQ ID NO: 1739 - protein, 20 aa, Artificial Sequence
  Description of Artificial Sequence: Synthetic peptide
LQPGQGQPGYYPTSPQQIGQ

SEQ ID NO: 1740 - protein, 16 aa, Artificial Sequence
  Description of Artificial Sequence: Synthetic peptide
QGQPGYYPTSPQQIGQ

SEQ ID NO: 1741 - protein, 15 aa, Artificial Sequence
  Description of Artificial Sequence: Synthetic peptide
GQPGYYPTSPQQIGQ

SEQ ID NO: 1742 - protein, 15 aa, Artificial Sequence
  Description of Artificial Sequence: Synthetic peptide
GQPGYYPTSPQQPGQ

SEQ ID NO: 1743 - protein, 15 aa, Artificial Sequence
  Description of Artificial Sequence: Synthetic peptide
GQPGYYPTSPQQSGQ

SEQ ID NO: 1744 - protein, 15 aa, Artificial Sequence
  Description of Artificial Sequence: Synthetic peptide
GQQGYYPTSLQQPGQ

SEQ ID NO: 1745 - protein, 36 aa, Artificial Sequence
  Description of Artificial Sequence: Synthetic polypeptide
SGQGQRPGQWLQPGQGQQGYYPTSPQQSGQGQQLGQ

SEQ ID NO: 1746 - protein, 18 aa, Artificial Sequence
  Description of Artificial Sequence: Synthetic peptide
PGQGQQGYYPTSPQQSGQ

SEQ ID NO: 1747 - protein, 15 aa, Artificial Sequence
  Description of Artificial Sequence: Synthetic peptide
GQQGYYPTSPQQSGQ

SEQ ID NO: 1748 - protein, 14 aa, Artificial Sequence
  Description of Artificial Sequence: Synthetic peptide
GQQGYYPTSPQQSG

SEQ ID NO: 1749 - protein, 13 aa, Artificial Sequence
  Description of Artificial Sequence: Synthetic peptide
GQQGYYPTSPQQS

SEQ ID NO: 1750 - protein, 14 aa, Artificial Sequence
  Description of Artificial Sequence: Synthetic peptide
QQGYYPTSPQQSGQ

SEQ ID NO: 1751 - protein, 13 aa, Artificial Sequence
  Description of Artificial Sequence: Synthetic peptide
QQGYYPTSPQQSG

SEQ ID NO: 1752 - protein, 13 aa, Artificial Sequence
  Description of Artificial Sequence: Synthetic peptide
QEGYYPTSPQQSG

SEQ ID NO: 1753 - protein, 12 aa, Artificial Sequence
  Description of Artificial Sequence: Synthetic peptide
QQGYYPTSPQQS

SEQ ID NO: 1754 - protein, 12 aa, Artificial Sequence
  Description of Artificial Sequence: Synthetic peptide
QGYYPTSPQQSG

SEQ ID NO: 1755 - protein, 11 aa, Artificial Sequence
  Description of Artificial Sequence: Synthetic peptide
QGYYPTSPQQS

SEQ ID NO: 1756 - protein, 11 aa, Artificial Sequence
  Description of Artificial Sequence: Synthetic peptide
GYYPTSPQQSG

SEQ ID NO: 1757 - protein, 15 aa, Artificial Sequence
  Description of Artificial Sequence: Synthetic peptide
GQQGYYPISPQQPGQ

SEQ ID NO: 1758 - protein, 15 aa, Artificial Sequence
  Description of Artificial Sequence: Synthetic peptide
GQQGYYPTSPQQSPQ

SEQ ID NO: 1759 - protein, 15 aa, Artificial Sequence
  Description of Artificial Sequence: Synthetic peptide
GQQGYYPTSPQQLGQ

SEQ ID NO: 1760 - protein, 15 aa, Artificial Sequence
  Description of Artificial Sequence: Synthetic peptide
GQQGYYPTSPQHPGQ

SEQ ID NO: 1761 - protein, 15 aa, Artificial Sequence
  Description of Artificial Sequence: Synthetic peptide
GQPGYYPTSPLQSGQ

SEQ ID NO: 1762 - protein, 15 aa, Artificial Sequence
  Description of Artificial Sequence: Synthetic peptide
GQHGYYPTSPQLSGQ

SEQ ID NO: 1763 - protein, 15 aa, Artificial Sequence
  Description of Artificial Sequence: Synthetic peptide
GQQGYYPTSPQQPPQ

SEQ ID NO: 1764 - protein, 15 aa, Artificial Sequence
  Description of Artificial Sequence: Synthetic peptide
GQQGYYPTSVQQPGQ

SEQ ID NO: 1765 - protein, 20 aa, Artificial Sequence
  Description of Artificial Sequence: Synthetic peptide
QPQQPQPFPQQPVPQQPQPY

SEQ ID NO: 1766 - protein, 16 aa, Artificial Sequence
  Description of Artificial Sequence: Synthetic peptide
PQQPQPFPQQPVPQQP

SEQ ID NO: 1767 - protein, 12 aa, Artificial Sequence
  Description of Artificial Sequence: Synthetic peptide
PQQPVPQQPQPY

SEQ ID NO: 1768 - protein, 20 aa, Artificial Sequence
  Description of Artificial Sequence: Synthetic peptide
PQPFPQQPIPQQPQPYPQQP

SEQ ID NO: 1769 - protein, 20 aa, Artificial Sequence
  Description of Artificial Sequence: Synthetic peptide
PQPFPQQPIPEQPQPYPQQP

SEQ ID NO: 1770 - protein, 16 aa, Artificial Sequence
  Description of Artificial Sequence: Synthetic peptide
PQPFPQQPIPQQPQPY

SEQ ID NO: 1771 - protein, 16 aa, Artificial Sequence
  Description of Artificial Sequence: Synthetic peptide
PQPFPQQPIPEQPQPY

SEQ ID NO: 1772 - protein, 20 aa, Artificial Sequence
  Description of Artificial Sequence: Synthetic peptide
QQPQPFSQQPIPQQPQPYPQ

SEQ ID NO: 1773 - protein, 20 aa, Artificial Sequence
  Description of Artificial Sequence: Synthetic peptide
QQPQPFSQQPIPEQPQPYPQ

SEQ ID NO: 1774 - protein, 12 aa, Artificial Sequence
  Description of Artificial Sequence: Synthetic peptide
SQQPIPQQPQPY

SEQ ID NO: 1775 - protein, 12 aa, Artificial Sequence
  Description of Artificial Sequence: Synthetic peptide
SQQPIPEQPQPY

SEQ ID NO: 1776 - protein, 20 aa, Artificial Sequence
  Description of Artificial Sequence: Synthetic peptide
QPQPFPQQPIPLQPHQPYTQ

SEQ ID NO: 1777 - protein, 12 aa, Artificial Sequence
  Description of Artificial Sequence: Synthetic peptide
QPQPFPQQPIPL

SEQ ID NO: 1778 - protein, 20 aa, Artificial Sequence
  Description of Artificial Sequence: Synthetic peptide
PQPYPQQPQPFPQQPPFCQQ

SEQ ID NO: 1779 - protein, 16 aa, Artificial Sequence
  Description of Artificial Sequence: Synthetic peptide
PQPYPQQPQPFPQQPP

SEQ ID NO: 1780 - protein, 20 aa, Artificial Sequence
  Description of Artificial Sequence: Synthetic peptide
QQPFPQQPFPQQPQPYPQQP

SEQ ID NO: 1781 - protein, 16 aa, Artificial Sequence
  Description of Artificial Sequence: Synthetic peptide
QQPFPQQPFPQQPQPY

SEQ ID NO: 1782 - protein, 11 aa, Artificial Sequence
  Description of Artificial Sequence: Synthetic peptide
QQPFPQQPFPQ

SEQ ID NO: 1783 - protein, 16 aa, Artificial Sequence
  Description of Artificial Sequence: Synthetic peptide
PQQPFPQQPQPYPQQP

SEQ ID NO: 1784 - protein, 20 aa, Artificial Sequence
  Description of Artificial Sequence: Synthetic peptide
QPQPYPQQPQPYPQQPFQPQ

SEQ ID NO: 1785 - protein, 12 aa, Artificial Sequence
  Description of Artificial Sequence: Synthetic peptide
QPQPYPQQPQPY

SEQ ID NO: 1786 - protein, 21 aa, Artificial Sequence
  Description of Artificial Sequence: Synthetic peptide
QPQPFPQQSEQSQQPFQPQPF

SEQ ID NO: 1787 - protein, 20 aa, Artificial Sequence
  Description of Artificial Sequence: Synthetic peptide
QPQQPFPQPQQPIPYQPQQP

SEQ ID NO: 1788 - protein, 16 aa, Artificial Sequence
  Description of Artificial Sequence: Synthetic peptide
GQQPFPQPEQPIPYQG

SEQ ID NO: 1789 - protein, 12 aa, Artificial Sequence
  Description of Artificial Sequence: Synthetic peptide
QPFPQPQQPIPY

SEQ ID NO: 1790 - protein, 12 aa, Artificial Sequence
  Description of Artificial Sequence: Synthetic peptide
QPFPQPEQPIPY

SEQ ID NO: 1791 - protein, 20 aa, Artificial Sequence
  Description of Artificial Sequence: Synthetic peptide
WQPQQPFPQPQQPFPLQPQQ

SEQ ID NO: 1792 - protein, 20 aa, Artificial Sequence
  Description of Artificial Sequence: Synthetic peptide
WQPQQPFPQPEQPFPLQPQQ

SEQ ID NO: 1793 - protein, 16 aa, Artificial Sequence
  Description of Artificial Sequence: Synthetic peptide
GQQPFPQPEQPFPLQG

SEQ ID NO: 1794 - protein, 12 aa, Artificial Sequence
  Description of Artificial Sequence: Synthetic peptide
QPFPQPQQPFPL

SEQ ID NO: 1795 - protein, 12 aa, Artificial Sequence
  Description of Artificial Sequence: Synthetic peptide
QPFPQPEQPFPL

SEQ ID NO: 1796 - protein, 20 aa, Artificial Sequence
  Description of Artificial Sequence: Synthetic peptide
LPRPQQPFPWQPQQPFPQPQ

SEQ ID NO: 1797 - protein, 20 aa, Artificial Sequence
  Description of Artificial Sequence: Synthetic peptide
QPQQPFPLQPQQPFPWQPQQ

SEQ ID NO: 1798 - protein, 12 aa, Artificial Sequence
  Description of Artificial Sequence: Synthetic peptide
PFPLQPQQPFPW

SEQ ID NO: 1799 - protein, 20 aa, Artificial Sequence
  Description of Artificial Sequence: Synthetic peptide
QPQQPFSFSQQPQQPFPLQP

SEQ ID NO: 1800 - protein, 16 aa, Artificial Sequence
  Description of Artificial Sequence: Synthetic peptide
GFSFSQQPEQPFPLQG

SEQ ID NO: 1801 - protein, 20 aa, Artificial Sequence
  Description of Artificial Sequence: Synthetic peptide
FQQPQQSYPVQPQQPFPQPQ

SEQ ID NO: 1802 - protein, 16 aa, Artificial Sequence
  Description of Artificial Sequence: Synthetic peptide
GQSYPVQPEQPFPQPG

SEQ ID NO: 1803 - protein, 12 aa, Artificial Sequence
  Description of Artificial Sequence: Synthetic peptide
SYPVQPQQPFPQ

SEQ ID NO: 1804 - protein, 12 aa, Artificial Sequence
  Description of Artificial Sequence: Synthetic peptide
SYPVQPEQPFPQ

SEQ ID NO: 1805 - protein, 12 aa, Artificial Sequence
  Description of Artificial Sequence: Synthetic peptide
SFSQQPQQPFPL

SEQ ID NO: 1806 - protein, 12 aa, Artificial Sequence
  Description of Artificial Sequence: Synthetic peptide
SFSQQPEQPFPL

SEQ ID NO: 1807 - protein, 16 aa, Artificial Sequence
  Description of Artificial Sequence: Synthetic peptide
GQPFPWQPEQPFPQPG

SEQ ID NO: 1808 - protein, 20 aa, Artificial Sequence
  Description of Artificial Sequence: Synthetic peptide
YPQQPQPFPQQPIPQQPQPY

SEQ ID NO: 1809 - protein, 12 aa, Artificial Sequence
  Description of Artificial Sequence: Synthetic peptide
QPQPFPQQPIPQ

SEQ ID NO: 1810 - protein, 9 aa, Artificial Sequence
  Description of Artificial Sequence: Synthetic peptide
PIPQQPQPY

SEQ ID NO: 1811 - protein, 9 aa, Artificial Sequence
  Description of Artificial Sequence: Synthetic peptide
PIPEQPQPY

SEQ ID NO: 1812 - protein, 20 aa, Artificial Sequence
  Description of Artificial Sequence: Synthetic peptide
QQQPFPQQPIPQQPQPYPQQ

SEQ ID NO: 1813 - protein, 11 aa, Artificial Sequence
  Description of Artificial Sequence: Synthetic peptide
QQPFPQQPIPQ

SEQ ID NO: 1814 - protein, 16 aa, Artificial Sequence
  Description of Artificial Sequence: Synthetic peptide
PQQPIPQQPQPYPQQP

SEQ ID NO: 1815 - protein, 16 aa, Artificial Sequence
  Description of Artificial Sequence: Synthetic peptide
PQQPIPEQPQPYPQQP

SEQ ID NO: 1816 - protein, 16 aa, Artificial Sequence
  Description of Artificial Sequence: Synthetic peptide
QPQQPIPQQPQPYPQQ

SEQ ID NO: 1817 - protein, 16 aa, Artificial Sequence
  Description of Artificial Sequence: Synthetic peptide
EPEQPIPEQPQPYPQQ

SEQ ID NO: 1818 - protein, 9 aa, Artificial Sequence
  Description of Artificial Sequence: Synthetic peptide
FPPQQPFPQ

SEQ ID NO: 1819 - protein, 9 aa, Artificial Sequence
  Description of Artificial Sequence: Synthetic peptide
FPPEQPFPQ

SEQ ID NO: 1820 - protein, 20 aa, Artificial Sequence
  Description of Artificial Sequence: Synthetic peptide
PFPQQPQQPFPQPQQPFRQQ

SEQ ID NO: 1821 - protein, 20 aa, Artificial Sequence
  Description of Artificial Sequence: Synthetic peptide
PFPQQPQQPFPQPEQPFRQQ

SEQ ID NO: 1822 - protein, 14 aa, Artificial Sequence
  Description of Artificial Sequence: Synthetic peptide
PQQPFPQPQQPFRQ

SEQ ID NO: 1823 - protein, 14 aa, Artificial Sequence
  Description of Artificial Sequence: Synthetic peptide
PQQPFPQPEQPFRQ

SEQ ID NO: 1824 - protein, 13 aa, Artificial Sequence
  Description of Artificial Sequence: Synthetic peptide
QQPFPQPQQPFRQ

SEQ ID NO: 1825 - protein, 13 aa, Artificial Sequence
  Description of Artificial Sequence: Synthetic peptide
QQPFPQPEQPFRQ

SEQ ID NO: 1826 - protein, 9 aa, Artificial Sequence
  Description of Artificial Sequence: Synthetic peptide
PFPQPQQPF

SEQ ID NO: 1827 - protein, 9 aa, Artificial Sequence
  Description of Artificial Sequence: Synthetic peptide
PFPQPEQPF

SEQ ID NO: 1828 - protein, 20 aa, Artificial Sequence
  Description of Artificial Sequence: Synthetic peptide
PQQPFQPQQPFPQQTIPQQP

SEQ ID NO: 1829 - protein, 12 aa, Artificial Sequence
  Description of Artificial Sequence: Synthetic peptide
QQPFQPQQPFPQ

SEQ ID NO: 1830 - protein, 20 aa, Artificial Sequence
  Description of Artificial Sequence: Synthetic peptide
TFPPSQQPNPLQPQQPFPLQ

SEQ ID NO: 1831 - protein, 13 aa, Artificial Sequence
  Description of Artificial Sequence: Synthetic peptide
PNPLQPQQPFPLQ

SEQ ID NO: 1832 - protein, 20 aa, Artificial Sequence
  Description of Artificial Sequence: Synthetic peptide
NPLQPQQPFPLQPQPPQQPF

SEQ ID NO: 1833 - protein, 16 aa, Artificial Sequence
  Description of Artificial Sequence: Synthetic peptide
NPLQPQQPFPLQPQPP

SEQ ID NO: 1834 - protein, 16 aa, Artificial Sequence
  Description of Artificial Sequence: Synthetic peptide
PLQPQQPFPLQPQPPQ

SEQ ID NO: 1835 - protein, 20 aa, Artificial Sequence
  Description of Artificial Sequence: Synthetic peptide
PQQPQQPFPQPQQPFSWQPQ

SEQ ID NO: 1836 - protein, 20 aa, Artificial Sequence
  Description of Artificial Sequence: Synthetic peptide
PQQPQQPFPQPEQPFSWQPQ

SEQ ID NO: 1837 - protein, 12 aa, Artificial Sequence
  Description of Artificial Sequence: Synthetic peptide
QPFPQPQQPFSW

SEQ ID NO: 1838 - protein, 12 aa, Artificial Sequence
  Description of Artificial Sequence: Synthetic peptide
QPFPQPEQPFSW

SEQ ID NO: 1839 - protein, 20 aa, Artificial Sequence
  Description of Artificial Sequence: Synthetic peptide
PQQTIPQQPQQPFPLQPQQP

SEQ ID NO: 1840 - protein, 12 aa, Artificial Sequence
  Description of Artificial Sequence: Synthetic peptide
TIPQQPQQPFPL

SEQ ID NO: 1841 - protein, 20 aa, Artificial Sequence
  Description of Artificial Sequence: Synthetic peptide
QQPFPLQPQQPFPQPQPFPQ

SEQ ID NO: 1842 - protein, 16 aa, Artificial Sequence
  Description of Artificial Sequence: Synthetic peptide
GQPFPLQPEQPFPQPG

SEQ ID NO: 1843 - protein, 12 aa, Artificial Sequence
  Description of Artificial Sequence: Synthetic peptide
PFPLQPEQPFPQ

SEQ ID NO: 1844 - protein, 20 aa, Artificial Sequence
  Description of Artificial Sequence: Synthetic peptide
QSQQQFPQPQQPFPQQPQQP

SEQ ID NO: 1845 - protein, 14 aa, Artificial Sequence
  Description of Artificial Sequence: Synthetic peptide
QQFPQPQQPFPQQP

SEQ ID NO: 1846 - protein, 14 aa, Artificial Sequence
  Description of Artificial Sequence: Synthetic peptide
QEFPQPQQPFPQQP

SEQ ID NO: 1847 - protein, 14 aa, Artificial Sequence
  Description of Artificial Sequence: Synthetic peptide
QQFPQPEQPFPQQP

SEQ ID NO: 1848 - protein, 14 aa, Artificial Sequence
  Description of Artificial Sequence: Synthetic peptide
QEFPQPEQPFPQQP

SEQ ID NO: 1849 - protein, 12 aa, Artificial Sequence
  Description of Artificial Sequence: Synthetic peptide
QQFPQPQQPFPQ

SEQ ID NO: 1850 - protein, 9 aa, Artificial Sequence
  Description of Artificial Sequence: Synthetic peptide
PQPQQPFPQ

SEQ ID NO: 1851 - protein, 9 aa, Artificial Sequence
  Description of Artificial Sequence: Synthetic peptide
PQPEQPFPQ

SEQ ID NO: 1852 - protein, 16 aa, Artificial Sequence
  Description of Artificial Sequence: Synthetic peptide
GQPAPIQPEQPFPQQG

SEQ ID NO: 1853 - protein, 20 aa, Artificial Sequence
  Description of Artificial Sequence: Synthetic peptide
PAPIQPQQPFPQQPQQPFPQ

SEQ ID NO: 1854 - protein, 12 aa, Artificial Sequence
  Description of Artificial Sequence: Synthetic peptide
PAPIQPEQPFPQ

SEQ ID NO: 1855 - protein, 12 aa, Artificial Sequence
  Description of Artificial Sequence: Synthetic peptide
PAPIQPQQPFPQ

SEQ ID NO: 1856 - protein, 20 aa, Artificial Sequence
  Description of Artificial Sequence: Synthetic peptide
FPQQPQQPFPQPQQQLPLQP

SEQ ID NO: 1857 - protein, 16 aa, Artificial Sequence
  Description of Artificial Sequence: Synthetic peptide
GQQPFPQPEQELPLQG

SEQ ID NO: 1858 - protein, 12 aa, Artificial Sequence
  Description of Artificial Sequence: Synthetic peptide
QPFPQPQQQLPL

SEQ ID NO: 1859 - protein, 12 aa, Artificial Sequence
  Description of Artificial Sequence: Synthetic peptide
QPFPQPEQELPL

SEQ ID NO: 1860 - protein, 20 aa, Artificial Sequence
  Description of Artificial Sequence: Synthetic peptide
PTPIQPQQPFPQRPQQPFPQ

SEQ ID NO: 1861 - protein, 12 aa, Artificial Sequence
  Description of Artificial Sequence: Synthetic peptide
PFPQRPQQPFPQ

SEQ ID NO: 1862 - protein, 9 aa, Artificial Sequence
  Description of Artificial Sequence: Synthetic peptide
PQQSFPQQP

SEQ ID NO: 1863 - protein, 9 aa, Artificial Sequence
  Description of Artificial Sequence: Synthetic peptide
PQQSFPEQP

SEQ ID NO: 1864 - protein, 20 aa, Artificial Sequence
  Description of Artificial Sequence: Synthetic peptide
FPLQPQQPFPQQPEQIISQQ

SEQ ID NO: 1865 - protein, 12 aa, Artificial Sequence
  Description of Artificial Sequence: Synthetic peptide
PFPQQPEQIISQ

SEQ ID NO: 1866 - protein, 20 aa, Artificial Sequence
  Description of Artificial Sequence: Synthetic peptide
FPQQPEQIISQQPQQPFPLQ

SEQ ID NO: 1867 - protein, 15 aa, Artificial Sequence
  Description of Artificial Sequence: Synthetic peptide
PEQIISQQPQQPFPL

SEQ ID NO: 1868 - protein, 20 aa, Artificial Sequence
  Description of Artificial Sequence: Synthetic peptide
PQQLFPLPQQPFPQPQQPFP

SEQ ID NO: 1869 - protein, 11 aa, Artificial Sequence
  Description of Artificial Sequence: Synthetic peptide
LFPLPQQPFPQ

SEQ ID NO: 1870 - protein, 14 aa, Artificial Sequence
  Description of Artificial Sequence: Synthetic peptide
PQQPFPQPQQPFPQ

SEQ ID NO: 1871 - protein, 14 aa, Artificial Sequence
  Description of Artificial Sequence: Synthetic peptide
PEQPFPQPQQPFPQ

SEQ ID NO: 1872 - protein, 14 aa, Artificial Sequence
  Description of Artificial Sequence: Synthetic peptide
PQQPFPQPEQPFPQ

SEQ ID NO: 1873 - protein, 14 aa, Artificial Sequence
  Description of Artificial Sequence: Synthetic peptide
PEQPFPQPEQPFPQ

SEQ ID NO: 1874 - protein, 14 aa, Artificial Sequence
  Description of Artificial Sequence: Synthetic peptide
QPFPQPQQPFPQSQ

SEQ ID NO: 1875 - protein, 14 aa, Artificial Sequence
  Description of Artificial Sequence: Synthetic peptide
QPFPQPEQPFPQSQ

SEQ ID NO: 1876 - protein, 20 aa, Artificial Sequence
  Description of Artificial Sequence: Synthetic peptide
NMQVGPSGQVEWPQQQPLPQ

SEQ ID NO: 1877 - protein, 16 aa, Artificial Sequence
  Description of Artificial Sequence: Synthetic peptide
GMQVGPSGEVEWPQQG

SEQ ID NO: 1878 - protein, 12 aa, Artificial Sequence
  Description of Artificial Sequence: Synthetic peptide
QVGPSGQVEWPQ

SEQ ID NO: 1879 - protein, 12 aa, Artificial Sequence
  Description of Artificial Sequence: Synthetic peptide
QVGPSGEVEWPQ

SEQ ID NO: 1880 - protein, 20 aa, Artificial Sequence
  Description of Artificial Sequence: Synthetic peptide
SPQPQQPYPQQPFPQQPQQP

SEQ ID NO: 1881 - protein, 16 aa, Artificial Sequence
  Description of Artificial Sequence: Synthetic peptide
GQPEQPYPEQPFPQQG

SEQ ID NO: 1882 - protein, 12 aa, Artificial Sequence
  Description of Artificial Sequence: Synthetic peptide
PQQPYPQQPFPQ

SEQ ID NO: 1883 - protein, 12 aa, Artificial Sequence
  Description of Artificial Sequence: Synthetic peptide
PEQPYPEQPFPQ

SEQ ID NO: 1884 - protein, 20 aa, Artificial Sequence
  Description of Artificial Sequence: Synthetic peptide
PQTQQPQQPFPQPQQPQQLF

SEQ ID NO: 1885 - protein, 12 aa, Artificial Sequence
  Description of Artificial Sequence: Synthetic peptide
PQTQQPQQPFPQ

SEQ ID NO: 1886 - protein, 20 aa, Artificial Sequence
  Description of Artificial Sequence: Synthetic peptide
PQEPQQLFPQSQQPQQPFPQ

SEQ ID NO: 1887 - protein, 12 aa, Artificial Sequence
  Description of Artificial Sequence: Synthetic peptide
PQSQQPQQPFPQ

SEQ ID NO: 1888 - protein, 20 aa, Artificial Sequence
  Description of Artificial Sequence: Synthetic peptide
QTQQSIPQPQQPFPQPQQPF

SEQ ID NO: 1889 - protein, 12 aa, Artificial Sequence
  Description of Artificial Sequence: Synthetic peptide
QSIPQPQQPFPQ

SEQ ID NO: 1890 - protein, 20 aa, Artificial Sequence
  Description of Artificial Sequence: Synthetic peptide
SIPQPQQPFPQPQQPFPQSQ

SEQ ID NO: 1891 - protein, 20 aa, Artificial Sequence
  Description of Artificial Sequence: Synthetic peptide
SIPQPQQPFPQPEQPFPQSQ

SEQ ID NO: 1892 - protein, 16 aa, Artificial Sequence
  Description of Artificial Sequence: Synthetic peptide
GQQPFPQPEQPFPQSG

SEQ ID NO: 1893 - protein, 13 aa, Artificial Sequence
  Description of Artificial Sequence: Synthetic peptide
QPFPQPEQPFPQS

SEQ ID NO: 1894 - protein, 12 aa, Artificial Sequence
  Description of Artificial Sequence: Synthetic peptide
QPFPQPQQPFPQ

SEQ ID NO: 1895 - protein, 12 aa, Artificial Sequence
  Description of Artificial Sequence: Synthetic peptide
QPFPQPEQPFPQ

SEQ ID NO: 1896 - protein, 20 aa, Artificial Sequence
  Description of Artificial Sequence: Synthetic peptide
QYSPYQPQQPFPQPQQPTPI

SEQ ID NO: 1897 - protein, 16 aa, Artificial Sequence
  Description of Artificial Sequence: Synthetic peptide
GQYSPYQPEQPFPQPG

SEQ ID NO: 1898 - protein, 12 aa, Artificial Sequence
  Description of Artificial Sequence: Synthetic peptide
YSPYQPQQPFPQ

SEQ ID NO: 1899 - protein, 12 aa, Artificial Sequence
  Description of Artificial Sequence: Synthetic peptide
YSPYQPEQPFPQ

SEQ ID NO: 1900 - protein, 16 aa, Artificial Sequence
  Description of Artificial Sequence: Synthetic peptide
GQQPFPQPEQPTPIQG

SEQ ID NO: 1901 - protein, 20 aa, Artificial Sequence
  Description of Artificial Sequence: Synthetic peptide
QPFPQPQQPTPIQPQQPFPQ

SEQ ID NO: 1902 - protein, 12 aa, Artificial Sequence
  Description of Artificial Sequence: Synthetic peptide
QPFPQPEQPTPI

SEQ ID NO: 1903 - protein, 12 aa, Artificial Sequence
  Description of Artificial Sequence: Synthetic peptide
QPFPQPQQPTPI

SEQ ID NO: 1904 - protein, 16 aa, Artificial Sequence
  Description of Artificial Sequence: Synthetic peptide
GQPTPIQPEQPFPQQG

SEQ ID NO: 1905 - protein, 12 aa, Artificial Sequence
  Description of Artificial Sequence: Synthetic peptide
PTPIQPQQPFPQ

SEQ ID NO: 1906 - protein, 12 aa, Artificial Sequence
  Description of Artificial Sequence: Synthetic peptide
PTPIQPEQPFPQ

SEQ ID NO: 1907 - protein, 20 aa, Artificial Sequence
  Description of Artificial Sequence: Synthetic peptide
QQLPLQPQQPFPQPQQPIPQ

SEQ ID NO: 1908 - protein, 12 aa, Artificial Sequence
  Description of Artificial Sequence: Synthetic peptide
QLPLQPQQPFPQ

SEQ ID NO: 1909 - protein, 12 aa, Artificial Sequence
  Description of Artificial Sequence: Synthetic peptide
QPFPQPQQPIPQ

SEQ ID NO: 1910 - protein, 14 aa, Artificial Sequence
  Description of Artificial Sequence: Synthetic peptide
PQQPQQSFPQQPQR

SEQ ID NO: 1911 - protein, 14 aa, Artificial Sequence
  Description of Artificial Sequence: Synthetic peptide
PEQPQQSFPQQPQR

SEQ ID NO: 1912 - protein, 14 aa, Artificial Sequence
  Description of Artificial Sequence: Synthetic peptide
PQQPEQSFPQQPQR

SEQ ID NO: 1913 - protein, 14 aa, Artificial Sequence
  Description of Artificial Sequence: Synthetic peptide
PQQPQQSFPEQPQR

SEQ ID NO: 1914 - protein, 14 aa, Artificial Sequence
  Description of Artificial Sequence: Synthetic peptide
PEQPEQSFPQQPQR

SEQ ID NO: 1915 - protein, 14 aa, Artificial Sequence
  Description of Artificial Sequence: Synthetic peptide
PEQPQQSFPEQPQR

SEQ ID NO: 1916 - protein, 14 aa, Artificial Sequence
  Description of Artificial Sequence: Synthetic peptide
PQQPEQSFPEQPQR

SEQ ID NO: 1917 - protein, 14 aa, Artificial Sequence
  Description of Artificial Sequence: Synthetic peptide
PEQPEQSFPEQPQR

SEQ ID NO: 1918 - protein, 20 aa, Artificial Sequence
  Description of Artificial Sequence: Synthetic peptide
EQIISQQPFPLQPQQPFSQP

SEQ ID NO: 1919 - protein, 12 aa, Artificial Sequence
  Description of Artificial Sequence: Synthetic peptide
PFPLQPQQPFSQ

SEQ ID NO: 1920 - protein, 16 aa, Artificial Sequence
  Description of Artificial Sequence: Synthetic peptide
GQPQQPFPEQPEQIIG

SEQ ID NO: 1921 - protein, 20 aa, Artificial Sequence
  Description of Artificial Sequence: Synthetic peptide
PQQPFPQQPEQIIPQQPQQP

SEQ ID NO: 1922 - protein, 12 aa, Artificial Sequence
  Description of Artificial Sequence: Synthetic peptide
PQQPFPQQPEQI

SEQ ID NO: 1923 - protein, 12 aa, Artificial Sequence
  Description of Artificial Sequence: Synthetic peptide
PQQPFPEQPEQI

SEQ ID NO: 1924 - protein, 16 aa, Artificial Sequence
  Description of Artificial Sequence: Synthetic peptide
QQPFPQQPEQIIPQQP

SEQ ID NO: 1925 - protein, 16 aa, Artificial Sequence
  Description of Artificial Sequence: Synthetic peptide
EQPFPEQPEQIIPQQP

SEQ ID NO: 1926 - protein, 16 aa, Artificial Sequence
  Description of Artificial Sequence: Synthetic peptide
GQPFPQQPEQIIPQQG

SEQ ID NO: 1927 - protein, 12 aa, Artificial Sequence
  Description of Artificial Sequence: Synthetic peptide
PFPQQPEQIIPQ

SEQ ID NO: 1928 - protein, 12 aa, Artificial Sequence
  Description of Artificial Sequence: Synthetic peptide
PEQIIPQQPQQP

SEQ ID NO: 1929 - protein, 20 aa, Artificial Sequence
  Description of Artificial Sequence: Synthetic peptide
SQQPQRPQQPFPQQPQQIIP

SEQ ID NO: 1930 - protein, 13 aa, Artificial Sequence
  Description of Artificial Sequence: Synthetic peptide
RPQQPFPQQPQQI

SEQ ID NO: 1931 - protein, 20 aa, Artificial Sequence
  Description of Artificial Sequence: Synthetic peptide
QPQQIIPQQPQQPFPLQPQQ

SEQ ID NO: 1932 - protein, 12 aa, Artificial Sequence
  Description of Artificial Sequence: Synthetic peptide
IIPQQPQQPFPL

SEQ ID NO: 1933 - protein, 20 aa, Artificial Sequence
  Description of Artificial Sequence: Synthetic peptide
QQPQQPFPLQPQQPVPQQPQ

SEQ ID NO: 1934 - protein, 16 aa, Artificial Sequence
  Description of Artificial Sequence: Synthetic peptide
QQPQQPFPLQPQQPVP

SEQ ID NO: 1935 - protein, 16 aa, Artificial Sequence
  Description of Artificial Sequence: Synthetic peptide
QPFPLQPQQPVPQQPQ

SEQ ID NO: 1936 - protein, 20 aa, Artificial Sequence
  Description of Artificial Sequence: Synthetic peptide
QQPFLLQPQQPFSQPQQPFL

SEQ ID NO: 1937 - protein, 11 aa, Artificial Sequence
  Description of Artificial Sequence: Synthetic peptide
FLLQPQQPFSQ

SEQ ID NO: 1938 - protein, 20 aa, Artificial Sequence
  Description of Artificial Sequence: Synthetic peptide
SPQQPQLPFPQPQQPFVVVV

SEQ ID NO: 1939 - protein, 20 aa, Artificial Sequence
  Description of Artificial Sequence: Synthetic peptide
SPQQPQLPFPQPEQPFVVVV

SEQ ID NO: 1940 - protein, 12 aa, Artificial Sequence
  Description of Artificial Sequence: Synthetic peptide
LPFPQPQQPFVV

SEQ ID NO: 1941 - protein, 12 aa, Artificial Sequence
  Description of Artificial Sequence: Synthetic peptide
LPFPQPEQPFVV

SEQ ID NO: 1942 - protein, 14 aa, Artificial Sequence
  Description of Artificial Sequence: Synthetic peptide
QYQPYPEQQQPFVQ

SEQ ID NO: 1943 - protein, 14 aa, Artificial Sequence
  Description of Artificial Sequence: Synthetic peptide
QYQPYPEQEQPFVQ

SEQ ID NO: 1944 - protein, 15 aa, Artificial Sequence
  Description of Artificial Sequence: Synthetic peptide
EYQPYPEQEQPILQQ

SEQ ID NO: 1945 - protein, 15 aa, Artificial Sequence
  Description of Artificial Sequence: Synthetic peptide
QYQPYPQQQQPILQQ

SEQ ID NO: 1946 - protein, 9 aa, Artificial Sequence
  Description of Artificial Sequence: Synthetic peptide
PYPEQQQPF

SEQ ID NO: 1947 - protein, 9 aa, Artificial Sequence
  Description of Artificial Sequence: Synthetic peptide
PYPEQEQPF

SEQ ID NO: 1948 - protein, 31 aa, Artificial Sequence
  Description of Artificial Sequence: Synthetic polypeptide
TTTVQYDPSEQYQPYPEQQEPFVQQQPPFVQ

SEQ ID NO: 1949 - protein, 22 aa, Artificial Sequence
  Description of Artificial Sequence: Synthetic peptide
TTTVQYDPSEQYQPYPEQQEPF

SEQ ID NO: 1950 - protein, 28 aa, Artificial Sequence
  Description of Artificial Sequence: Synthetic peptide
TTTVQYNPSEQYQPYPEQQEPFVQQQPF

SEQ ID NO: 1951 - protein, 27 aa, Artificial Sequence
  Description of Artificial Sequence: Synthetic peptide
TTVQYNPSEQYQPYPEQQEPFVQQQPF

SEQ ID NO: 1952 - protein, 25 aa, Artificial Sequence
  Description of Artificial Sequence: Synthetic peptide
VQYNPSEQYQPYPEQQEPFVQQQPF

SEQ ID NO: 1953 - protein, 22 aa, Artificial Sequence
  Description of Artificial Sequence: Synthetic peptide
TTTVQYNPSEQYQPYPEQQEPF

SEQ ID NO: 1954 - protein, 29 aa, Artificial Sequence
  Description of Artificial Sequence: Synthetic peptide
TTTVQYDPSEQYQPYPEQQEPFVQQQQPF

SEQ ID NO: 1955 - protein, 30 aa, Artificial Sequence
  Description of Artificial Sequence: Synthetic polypeptide
TTTVQYNPSEQYQPYPEQQEPFVQQQQPFV

SEQ ID NO: 1956 - protein, 29 aa, Artificial Sequence
  Description of Artificial Sequence: Synthetic peptide
PSEQYQPYPEQQEPFVQQQQPFVQQQQPF

SEQ ID NO: 1957 - protein, 19 aa, Artificial Sequence
  Description of Artificial Sequence: Synthetic peptide
SEQYQPYPEQQEPFVQQQQ

SEQ ID NO: 1958 - protein, 19 aa, Artificial Sequence
  Description of Artificial Sequence: Synthetic peptide
SEQYQPYPEQEEPFVQQQQ

SEQ ID NO: 1959 - protein, 14 aa, Artificial Sequence
  Description of Artificial Sequence: Synthetic peptide
QYQPYPEQQEPFVQ

SEQ ID NO: 1960 - protein, 14 aa, Artificial Sequence
  Description of Artificial Sequence: Synthetic peptide
QYQPYPEQEEPFVQ

SEQ ID NO: 1961 - protein, 12 aa, Artificial Sequence
  Description of Artificial Sequence: Synthetic peptide
YQPYPEQQEPFV

SEQ ID NO: 1962 - protein, 12 aa, Artificial Sequence
  Description of Artificial Sequence: Synthetic peptide
YQPYPEQEEPFV

SEQ ID NO: 1963 - protein, 9 aa, Artificial Sequence
  Description of Artificial Sequence: Synthetic peptide
PYPEQQEPF

SEQ ID NO: 1964 - protein, 9 aa, Artificial Sequence
  Description of Artificial Sequence: Synthetic peptide
PYPEQEEPF

SEQ ID NO: 1965 - protein, 14 aa, Artificial Sequence
  Description of Artificial Sequence: Synthetic peptide
QQPFVQQQQPFVQQ

SEQ ID NO: 1966 - protein, 14 aa, Artificial Sequence
  Description of Artificial Sequence: Synthetic peptide
EQPFVQQQQPFVQQ

SEQ ID NO: 1967 - protein, 14 aa, Artificial Sequence
  Description of Artificial Sequence: Synthetic peptide
QQPFVEQQQPFVQQ

SEQ ID NO: 1968 - protein, 14 aa, Artificial Sequence
  Description of Artificial Sequence: Synthetic peptide
EQPFVEQQQPFVQQ

SEQ ID NO: 1969 - protein, 14 aa, Artificial Sequence
  Description of Artificial Sequence: Synthetic peptide
QQPFVQEQQPFVQQ

SEQ ID NO: 1970 - protein, 14 aa, Artificial Sequence
  Description of Artificial Sequence: Synthetic peptide
EQPFVQEQQPFVQQ

SEQ ID NO: 1971 - protein, 14 aa, Artificial Sequence
  Description of Artificial Sequence: Synthetic peptide
QQPFVEEQQPFVQQ

SEQ ID NO: 1972 - protein, 14 aa, Artificial Sequence
  Description of Artificial Sequence: Synthetic peptide
EQPFVEEQQPFVQQ

SEQ ID NO: 1973 - protein, 14 aa, Artificial Sequence
  Description of Artificial Sequence: Synthetic peptide
QQPFVQQEQPFVQQ

SEQ ID NO: 1974 - protein, 14 aa, Artificial Sequence
  Description of Artificial Sequence: Synthetic peptide
EQPFVQQEQPFVQQ

SEQ ID NO: 1975 - protein, 14 aa, Artificial Sequence
  Description of Artificial Sequence: Synthetic peptide
QQPFVEQEQPFVQQ

SEQ ID NO: 1976 - protein, 14 aa, Artificial Sequence
  Description of Artificial Sequence: Synthetic peptide
EQPFVEQEQPFVQQ

SEQ ID NO: 1977 - protein, 14 aa, Artificial Sequence
  Description of Artificial Sequence: Synthetic peptide
QQPFVQEEQPFVQQ

SEQ ID NO: 1978 - protein, 14 aa, Artificial Sequence
  Description of Artificial Sequence: Synthetic peptide
EQPFVQEEQPFVQQ

SEQ ID NO: 1979 - protein, 14 aa, Artificial Sequence
  Description of Artificial Sequence: Synthetic peptide
QQPFVEEEQPFVQQ

SEQ ID NO: 1980 - protein, 14 aa, Artificial Sequence
  Description of Artificial Sequence: Synthetic peptide
EQPFVEEEQPFVQQ

SEQ ID NO: 1981 - protein, 9 aa, Artificial Sequence
  Description of Artificial Sequence: Synthetic peptide
FVQQQQQPF

SEQ ID NO: 1982 - protein, 9 aa, Artificial Sequence
  Description of Artificial Sequence: Synthetic peptide
FVQQQEQPF

SEQ ID NO: 1983 - protein, 12 aa, Artificial Sequence
  Description of Artificial Sequence: Synthetic peptide
QSEQSQQPFQPQ

SEQ ID NO: 1984 - protein, 9 aa, Artificial Sequence
  Description of Artificial Sequence: Synthetic peptide
EQPQQPYPQ

SEQ ID NO: 1985 - protein, 9 aa, Artificial Sequence
  Description of Artificial Sequence: Synthetic peptide
QQPQQPYPE

SEQ ID NO: 1986 - protein, 9 aa, Artificial Sequence
  Description of Artificial Sequence: Synthetic peptide
EQPEQPYPQ

SEQ ID NO: 1987 - protein, 9 aa, Artificial Sequence
  Description of Artificial Sequence: Synthetic peptide
QQPEQPYPE

SEQ ID NO: 1988 - protein, 9 aa, Artificial Sequence
  Description of Artificial Sequence: Synthetic peptide
SQPEQQFPQ

SEQ ID NO: 1989 - protein, 9 aa, Artificial Sequence
  Description of Artificial Sequence: Synthetic peptide
SQPQQEFPQ

SEQ ID NO: 1990 - protein, 9 aa, Artificial Sequence
  Description of Artificial Sequence: Synthetic peptide
QQPQQPFPE

SEQ ID NO: 1991 - protein, 9 aa, Artificial Sequence
  Description of Artificial Sequence: Synthetic peptide
QQPEQPFPE

SEQ ID NO: 1992 - protein, 9 aa, Artificial Sequence
  Description of Artificial Sequence: Synthetic peptide
EQPEQPFPE

SEQ ID NO: 1993 - protein, 9 aa, Artificial Sequence
  Description of Artificial Sequence: Synthetic peptide
PQPQQPFCQ

SEQ ID NO: 1994 - protein, 9 aa, Artificial Sequence
  Description of Artificial Sequence: Synthetic peptide
PQPEQPFCQ

SEQ ID NO: 1995 - protein, 9 aa, Artificial Sequence
  Description of Artificial Sequence: Synthetic peptide
PQPQQPFCE

SEQ ID NO: 1996 - protein, 9 aa, Artificial Sequence
  Description of Artificial Sequence: Synthetic peptide
PQPEQPFCE

SEQ ID NO: 1997 - protein, 9 aa, Artificial Sequence
  Description of Artificial Sequence: Synthetic peptide
PQPQQPFSQ

SEQ ID NO: 1998 - protein, 9 aa, Artificial Sequence
  Description of Artificial Sequence: Synthetic peptide
PQPEQPFSQ

SEQ ID NO: 1999 - protein, 9 aa, Artificial Sequence
  Description of Artificial Sequence: Synthetic peptide
PFPQPQQPI

SEQ ID NO: 2000 - protein, 9 aa, Artificial Sequence
  Description of Artificial Sequence: Synthetic peptide
PFPQPEQPI

SEQ ID NO: 2001 - protein, 9 aa, Artificial Sequence
  Description of Artificial Sequence: Synthetic peptide
PQPQQPIPV

SEQ ID NO: 2002 - protein, 9 aa, Artificial Sequence
  Description of Artificial Sequence: Synthetic peptide
PQPEQPIPV

SEQ ID NO: 2003 - protein, 9 aa, Artificial Sequence
  Description of Artificial Sequence: Synthetic peptide
LQPQQPFPQ

SEQ ID NO: 2004 - protein, 9 aa, Artificial Sequence
  Description of Artificial Sequence: Synthetic peptide
LQPEQPFPQ

SEQ ID NO: 2005 - protein, 14 aa, Artificial Sequence
  Description of Artificial Sequence: Synthetic peptide
QQPFMQQQQPFMQP

SEQ ID NO: 2006 - protein, 14 aa, Artificial Sequence
  Description of Artificial Sequence: Synthetic peptide
QQPFVQQQQQPFVQ

SEQ ID NO: 2007 - protein, 9 aa, Artificial Sequence
  Description of Artificial Sequence: Synthetic peptide
PEQSFPQQQ

SEQ ID NO: 2008 - protein, 9 aa, Artificial Sequence
  Description of Artificial Sequence: Synthetic peptide
PEQSFPQQE

SEQ ID NO: 2009 - protein, 16 aa, Artificial Sequence
  Description of Artificial Sequence: Synthetic peptide
QYQPYPEQQQPILQQQ

SEQ ID NO: 2010 - protein, 16 aa, Artificial Sequence
  Description of Artificial Sequence: Synthetic peptide
QYQPYPEQEQPILQQQ

SEQ ID NO: 2011 - protein, 16 aa, Artificial Sequence
  Description of Artificial Sequence: Synthetic peptide
QQYQPYPQQQPFMQPL

SEQ ID NO: 2012 - protein, 16 aa, Artificial Sequence
  Description of Artificial Sequence: Synthetic peptide
EQYQPYPEQQPFMQPL

SEQ ID NO: 2013 - protein, 10 aa, Artificial Sequence
  Description of Artificial Sequence: Synthetic peptide
VMNILLQYVV

SEQ ID NO: 2014 - protein, 10 aa, Artificial Sequence
  Description of Artificial Sequence: Synthetic peptide
YAYDGKDYIA

SEQ ID NO: 2015 - protein, 9 aa, Artificial Sequence
  Description of Artificial Sequence: Synthetic peptide
MVWESGCTV

SEQ ID NO: 2016 - protein, 9 aa, Artificial Sequence
  Description of Artificial Sequence: Synthetic peptide
VIVMLTPLV

SEQ ID NO: 2017 - protein, 10 aa, Artificial Sequence
  Description of Artificial Sequence: Synthetic peptide
YTCPLCRAPV

SEQ ID NO: 2018 - protein, 9 aa, Artificial Sequence
  Description of Artificial Sequence: Synthetic peptide
YMDGTMSQV

SEQ ID NO: 2019 - protein, 10 aa, Artificial Sequence
  Description of Artificial Sequence: Synthetic peptide
YMVPFIPLYR

SEQ ID NO: 2020 - protein, 9 aa, Artificial Sequence
  Description of Artificial Sequence: Synthetic peptide
AFLPWHRLF

SEQ ID NO: 2021 - protein, 11 aa, Artificial Sequence
  Description of Artificial Sequence: Synthetic peptide
SSDYVIPIGTY

SEQ ID NO: 2022 - protein, 9 aa, Artificial Sequence
  Description of Artificial Sequence: Synthetic peptide
VLHDDLLEA

SEQ ID NO: 2023 - protein, 9 aa, Artificial Sequence
  Description of Artificial Sequence: Synthetic peptide
RTLDKVLEV

SEQ ID NO: 2024 - protein, 9 aa, Artificial Sequence
  Description of Artificial Sequence: Synthetic peptide
FIDSYICQV

SEQ ID NO: 2025 - protein, 19 aa, Artificial Sequence
  Description of Artificial Sequence: Synthetic peptide
GAGSLQPLALEGSLQKRGA

SEQ ID NO: 2026 - protein, 14 aa, Artificial Sequence
  Description of Artificial Sequence: Synthetic peptide
IAFTSEHSHFSLKA

SEQ ID NO: 2027 - protein, 19 aa, Artificial Sequence
  Description of Artificial Sequence: Synthetic peptide
DENPVVHFFKNIVTPRTPP

SEQ ID NO: 2028 - protein, 16 aa, Artificial Sequence
  Description of Artificial Sequence: Synthetic peptide
GIVEQCCTSICSLYQA

SEQ ID NO: 2029 - protein, 14 aa, Artificial Sequence
  Description of Artificial Sequence: Synthetic peptide
NFIRMVISNPAATA

SEQ ID NO: 2030 - protein, 20 aa, Artificial Sequence
  Description of Artificial Sequence: Synthetic peptide
DVMNILLQYVVKSFDRSTKV

SEQ ID NO: 2031 - protein, 10 aa, Artificial Sequence
  Description of Artificial Sequence: Synthetic peptide
ALWGPDPAAA

SEQ ID NO: 2032 - protein, 9 aa, Artificial Sequence
  Description of Artificial Sequence: Synthetic peptide
HLVEALYLV

SEQ ID NO: 2033 - protein, 9 aa, Artificial Sequence
  Description of Artificial Sequence: Synthetic peptide
KLQVFLIVL

SEQ ID NO: 2034 - protein, 9 aa, Artificial Sequence
  Description of Artificial Sequence: Synthetic peptide
IVDCLTEMY

SEQ ID NO: 2035 - protein, 9 aa, Artificial Sequence
  Description of Artificial Sequence: Synthetic peptide
VLHDDLLEA

SEQ ID NO: 2036 - protein, 9 aa, Artificial Sequence
  Description of Artificial Sequence: Synthetic peptide
RTLDKVLEV

SEQ ID NO: 2037 - protein, 9 aa, Artificial Sequence
  Description of Artificial Sequence: Synthetic peptide
FIDSYICQV

SEQ ID NO: 2038 - protein, 11 aa, Artificial Sequence
  Description of Artificial Sequence: Synthetic peptide
SPSVDKARAEL

SEQ ID NO: 2039 - protein, 8 aa, Artificial Sequence
  Description of Artificial Sequence: Synthetic peptide
LPHNHTDL

SEQ ID NO: 2040 - protein, 9 aa, Artificial Sequence
  Description of Artificial Sequence: Synthetic peptide
FLDKGTYTL

SEQ ID NO: 2041 - protein, 9 aa, Artificial Sequence
  Description of Artificial Sequence: Synthetic peptide
GLCTLVAML

SEQ ID NO: 2042 - protein, 9 aa, Artificial Sequence
  Description of Artificial Sequence: Synthetic peptide
TLDYKPLSV

SEQ ID NO: 2043 - protein, 9 aa, Artificial Sequence
  Description of Artificial Sequence: Synthetic peptide
YVLDHLIVV

SEQ ID NO: 2044 - protein, 10 aa, Artificial Sequence
  Description of Artificial Sequence: Synthetic peptide
LLDFVRFMGV

SEQ ID NO: 2045 - protein, 9 aa, Artificial Sequence
  Description of Artificial Sequence: Synthetic peptide
YLLEMLWRL

SEQ ID NO: 2046 - protein, 9 aa, Artificial Sequence
  Description of Artificial Sequence: Synthetic peptide
YLQQNWWTL

SEQ ID NO: 2047 - protein, 9 aa, Artificial Sequence
  Description of Artificial Sequence: Synthetic peptide
CLGGLLTMV

SEQ ID NO: 2048 - protein, 9 aa, Artificial Sequence
  Description of Artificial Sequence: Synthetic peptide
FLYALALLL

SEQ ID NO: 2049 - protein, 9 aa, Artificial Sequence
  Description of Artificial Sequence: Synthetic peptide
RLRAEAQVK

SEQ ID NO: 2050 - protein, 10 aa, Artificial Sequence
  Description of Artificial Sequence: Synthetic peptide
AVFDRKSDAK

SEQ ID NO: 2051 - protein, 9 aa, Artificial Sequence
  Description of Artificial Sequence: Synthetic peptide
IVTDFSVIK

SEQ ID NO: 2052 - protein, 10 aa, Artificial Sequence
  Description of Artificial Sequence: Synthetic peptide
DYCNVLNKEF

SEQ ID NO: 2053 - protein, 9 aa, Artificial Sequence
  Description of Artificial Sequence: Synthetic peptide
TYGPVFMCL

SEQ ID NO: 2054 - protein, 9 aa, Artificial Sequence
  Description of Artificial Sequence: Synthetic peptide
IACPIVMRY

SEQ ID NO: 2055 - protein, 13 aa, Artificial Sequence
  Description of Artificial Sequence: Synthetic peptide
RPQGGSRPEFVKL

SEQ ID NO: 2056 - protein, 9 aa, Artificial Sequence
  Description of Artificial Sequence: Synthetic peptide
RPPIFIRRL

SEQ ID NO: 2057 - protein, 9 aa, Artificial Sequence
  Description of Artificial Sequence: Synthetic peptide
QPRAPIRPI

SEQ ID NO: 2058 - protein, 8 aa, Artificial Sequence
  Description of Artificial Sequence: Synthetic peptide
RAKFKQLL

SEQ ID NO: 2059 - protein, 9 aa, Artificial Sequence
  Description of Artificial Sequence: Synthetic peptide
FLRGRAYGL

SEQ ID NO: 2060 - protein, 11 aa, Artificial Sequence
  Description of Artificial Sequence: Synthetic peptide
EPLPQGQLTAY

SEQ ID NO: 2061 - protein, 11 aa, Artificial Sequence
  Description of Artificial Sequence: Synthetic peptide
EPLSQSQITAY

SEQ ID NO: 2062 - protein, 11 aa, Artificial Sequence
  Description of Artificial Sequence: Synthetic peptide
HPVAEADYFEY

SEQ ID NO: 2063 - protein, 11 aa, Artificial Sequence
  Description of Artificial Sequence: Synthetic peptide
HPVGDADYFEY

SEQ ID NO: 2064 - protein, 11 aa, Artificial Sequence
  Description of Artificial Sequence: Synthetic peptide
HPVGEADYFEY

SEQ ID NO: 2065 - protein, 11 aa, Artificial Sequence
  Description of Artificial Sequence: Synthetic peptide
HPVGQADYFEY

SEQ ID NO: 2066 - protein, 9 aa, Artificial Sequence
  Description of Artificial Sequence: Synthetic peptide
YPLHEQHGM

SEQ ID NO: 2067 - protein, 9 aa, Artificial Sequence
  Description of Artificial Sequence: Synthetic peptide
VTEHDTLLY

SEQ ID NO: 2068 - protein, 9 aa, Artificial Sequence
  Description of Artificial Sequence: Synthetic peptide
VLEETSVML

SEQ ID NO: 2069 - protein, 9 aa, Artificial Sequence
  Description of Artificial Sequence: Synthetic peptide
NLVPMVATV

SEQ ID NO: 2070 - protein, 9 aa, Artificial Sequence
  Description of Artificial Sequence: Synthetic peptide
KLGGALQAK

SEQ ID NO: 2071 - protein, 9 aa, Artificial Sequence
  Description of Artificial Sequence: Synthetic peptide
QYDPVAALF

SEQ ID NO: 2072 - protein, 9 aa, Artificial Sequence
  Description of Artificial Sequence: Synthetic peptide
AYAQKIFKI

SEQ ID NO: 2073 - protein, 9 aa, Artificial Sequence
  Description of Artificial Sequence: Synthetic peptide
VYALPLKML

SEQ ID NO: 2074 - protein, 11 aa, Artificial Sequence
  Description of Artificial Sequence: Synthetic peptide
RPHERNGFTVL

SEQ ID NO: 2075 - protein, 10 aa, Artificial Sequence
  Description of Artificial Sequence: Synthetic peptide
TPRVTGGGAM

SEQ ID NO: 2076 - protein, 9 aa, Artificial Sequence
  Description of Artificial Sequence: Synthetic peptide
ELKRKMIYM

SEQ ID NO: 2077 - protein, 9 aa, Artificial Sequence
  Description of Artificial Sequence: Synthetic peptide
ELNRKMIYM

SEQ ID NO: 2078 - protein, 9 aa, Artificial Sequence
  Description of Artificial Sequence: Synthetic peptide
ELRRKMMYM

SEQ ID NO: 2079 - protein, 9 aa, Artificial Sequence
  Description of Artificial Sequence: Synthetic peptide
QIKVRVDMV

SEQ ID NO: 2080 - protein, 9 aa, Artificial Sequence
  Description of Artificial Sequence: Synthetic peptide
IPSINVHHY

SEQ ID NO: 2081 - protein, 13 aa, Artificial Sequence
  Description of Artificial Sequence: Synthetic peptide
LPLNVGLPIIGVM

SEQ ID NO: 2082 - protein, 9 aa, Artificial Sequence
  Description of Artificial Sequence: Synthetic peptide
SADNNNSEY

SEQ ID NO: 2083 - protein, 9 aa, Artificial Sequence
  Description of Artificial Sequence: Synthetic peptide
TDLGQNLLY

SEQ ID NO: 2084 - protein, 9 aa, Artificial Sequence
  Description of Artificial Sequence: Synthetic peptide
EADPTGHSY

SEQ ID NO: 2085 - protein, 9 aa, Artificial Sequence
  Description of Artificial Sequence: Synthetic peptide
EVDPIGHLY

SEQ ID NO: 2086 - protein, 9 aa, Artificial Sequence
  Description of Artificial Sequence: Synthetic peptide
KSDICTDEY

SEQ ID NO: 2087 - protein, 9 aa, Artificial Sequence
  Description of Artificial Sequence: Synthetic peptide
KCDICTDEY

SEQ ID NO: 2088 - protein, 9 aa, Artificial Sequence
  Description of Artificial Sequence: Synthetic peptide
QSLEIISRY

SEQ ID NO: 2089 - protein, 10 aa, Artificial Sequence
  Description of Artificial Sequence: Synthetic peptide
YVDFREYEYY

SEQ ID NO: 2090 - protein, 9 aa, Artificial Sequence
  Description of Artificial Sequence: Synthetic peptide
TLDTLTAFY

SEQ ID NO: 2091 - protein, 10 aa, Artificial Sequence
  Description of Artificial Sequence: Synthetic peptide
LTDDRLFTCY

SEQ ID NO: 2092 - protein, 10 aa, Artificial Sequence
  Description of Artificial Sequence: Synthetic peptide
DSDPDSFQDY

SEQ ID NO: 2093 - protein, 9 aa, Artificial Sequence
  Description of Artificial Sequence: Synthetic peptide
EADPIGHLY

SEQ ID NO: 2094 - protein, 9 aa, Artificial Sequence
  Description of Artificial Sequence: Synthetic peptide
EVDPASNTY

SEQ ID NO: 2095 - protein, 10 aa, Artificial Sequence
  Description of Artificial Sequence: Synthetic peptide
HSTNGVTRIY

SEQ ID NO: 2096 - protein, 10 aa, Artificial Sequence
  Description of Artificial Sequence: Synthetic peptide
ILDTAGREEY

SEQ ID NO: 2097 - protein, 10 aa, Artificial Sequence
  Description of Artificial Sequence: Synthetic peptide
LVDVMPWLQY

SEQ ID NO: 2098 - protein, 10 aa, Artificial Sequence
  Description of Artificial Sequence: Synthetic peptide
RSDSGQQARY

SEQ ID NO: 2099 - protein, 9 aa, Artificial Sequence
  Description of Artificial Sequence: Synthetic peptide
VTEPGTAQY

SEQ ID NO: 2100 - protein, 10 aa, Artificial Sequence
  Description of Artificial Sequence: Synthetic peptide
VYDFFVWLHY

SEQ ID NO: 2101 - protein, 11 aa, Artificial Sequence
  Description of Artificial Sequence: Synthetic peptide
YSEHPTFTSQY

SEQ ID NO: 2102 - protein, 9 aa, Artificial Sequence
  Description of Artificial Sequence: Synthetic peptide
VTEHDTLLY

SEQ ID NO: 2103 - protein, 9 aa, Artificial Sequence
  Description of Artificial Sequence: Synthetic peptide
FTSDYYQLY

SEQ ID NO: 2104 - protein, 10 aa, Artificial Sequence
  Description of Artificial Sequence: Synthetic peptide
TTDPSFLGRY

SEQ ID NO: 2105 - protein, 9 aa, Artificial Sequence
  Description of Artificial Sequence: Synthetic peptide
PTDNYITTY

SEQ ID NO: 2106 - protein, 9 aa, Artificial Sequence
  Description of Artificial Sequence: Synthetic peptide
LLDTASALY

SEQ ID NO: 2107 - protein, 9 aa, Artificial Sequence
  Description of Artificial Sequence: Synthetic peptide
ATDALMTGY

SEQ ID NO: 2108 - protein, 9 aa, Artificial Sequence
  Description of Artificial Sequence: Synthetic peptide
ATDALMTGF

SEQ ID NO: 2109 - protein, 9 aa, Artificial Sequence
  Description of Artificial Sequence: Synthetic peptide
CTELKLSDY

SEQ ID NO: 2110 - protein, 9 aa, Artificial Sequence
  Description of Artificial Sequence: Synthetic peptide
VSDGGPNLY

SEQ ID NO: 2111 - protein, 9 aa, Artificial Sequence
  Description of Artificial Sequence: Synthetic peptide
IVDCLTEMY

SEQ ID NO: 2112 - protein, 9 aa, Artificial Sequence
  Description of Artificial Sequence: Synthetic peptide
ALCNTDSPL

SEQ ID NO: 2113 - protein, 9 aa, Artificial Sequence
  Description of Artificial Sequence: Synthetic peptide
ALKDVEERV

SEQ ID NO: 2114 - protein, 10 aa, Artificial Sequence
  Description of Artificial Sequence: Synthetic peptide
LLAARAIVAI

SEQ ID NO: 2115 - protein, 9 aa, Artificial Sequence
  Description of Artificial Sequence: Synthetic peptide
RLWQELSDI

SEQ ID NO: 2116 - protein, 10 aa, Artificial Sequence
  Description of Artificial Sequence: Synthetic peptide
LLFGLALIEV

SEQ ID NO: 2117 - protein, 9 aa, Artificial Sequence
  Description of Artificial Sequence: Synthetic peptide
FLDPRPLTV

SEQ ID NO: 2118 - protein, 9 aa, Artificial Sequence
  Description of Artificial Sequence: Synthetic peptide
STLCQVEPV

SEQ ID NO: 2119 - protein, 9 aa, Artificial Sequence
  Description of Artificial Sequence: Synthetic peptide
VLQMKEEDV

SEQ ID NO: 2120 - protein, 9 aa, Artificial Sequence
  Description of Artificial Sequence: Synthetic peptide
AIQDLCLAV

SEQ ID NO: 2121 - protein, 9 aa, Artificial Sequence
  Description of Artificial Sequence: Synthetic peptide
QLLIKAVNL

SEQ ID NO: 2122 - protein, 9 aa, Artificial Sequence
  Description of Artificial Sequence: Synthetic peptide
AIQDLCVAV

SEQ ID NO: 2123 - protein, 9 aa, Artificial Sequence
  Description of Artificial Sequence: Synthetic peptide
ALTPVVVTL

SEQ ID NO: 2124 - protein, 9 aa, Artificial Sequence
  Description of Artificial Sequence: Synthetic peptide
KLQVFLIVL

SEQ ID NO: 2125 - protein, 9 aa, Artificial Sequence
  Description of Artificial Sequence: Synthetic peptide
VMNILLQYV

SEQ ID NO: 2126 - protein, 9 aa, Artificial Sequence
  Description of Artificial Sequence: Synthetic peptide
SLSRFSWGA

SEQ ID NO: 2127 - protein, 9 aa, Artificial Sequence
  Description of Artificial Sequence: Synthetic peptide
HLVEALYLV

SEQ ID NO: 2128 - protein, 9 aa, Artificial Sequence
  Description of Artificial Sequence: Synthetic peptide
LNIDLLWSV

SEQ ID NO: 2129 - protein, 9 aa, Artificial Sequence
  Description of Artificial Sequence: Synthetic peptide
VLFGLGFAI

SEQ ID NO: 2130 - protein, 10 aa, Artificial Sequence
  Description of Artificial Sequence: Synthetic peptide
ALWGPDPAAA

SEQ ID NO: 2131 - protein, 9 aa, Artificial Sequence
  Description of Artificial Sequence: Synthetic peptide
MVWESGCTV

SEQ ID NO: 2132 - protein, 10 aa, Artificial Sequence
  Description of Artificial Sequence: Synthetic peptide
YTCPLCRAPV

SEQ ID NO: 2133 - protein, 9 aa, Artificial Sequence
  Description of Artificial Sequence: Synthetic peptide
VIVMLTPLV

SEQ ID NO: 2134 - protein, 9 aa, Artificial Sequence
  Description of Artificial Sequence: Synthetic peptide
AITEVECFL

SEQ ID NO: 2135 - protein, 9 aa, Artificial Sequence
  Description of Artificial Sequence: Synthetic peptide
FLHCIVFNV

SEQ ID NO: 2136 - protein, 9 aa, Artificial Sequence
  Description of Artificial Sequence: Synthetic peptide
LLMWEAVTV

SEQ ID NO: 2137 - protein, 9 aa, Artificial Sequence
  Description of Artificial Sequence: Synthetic peptide
CLLPKMDSV

SEQ ID NO: 2138 - protein, 9 aa, Artificial Sequence
  Description of Artificial Sequence: Synthetic peptide
FLWGPRALV

SEQ ID NO: 2139 - protein, 9 aa, Artificial Sequence
  Description of Artificial Sequence: Synthetic peptide
IMDQVPFSV

SEQ ID NO: 2140 - protein, 9 aa, Artificial Sequence
  Description of Artificial Sequence: Synthetic peptide
YLEPGPVTV

SEQ ID NO: 2141 - protein, 9 aa, Artificial Sequence
  Description of Artificial Sequence: Synthetic peptide
YLSGADLNL

SEQ ID NO: 2142 - protein, 9 aa, Artificial Sequence
  Description of Artificial Sequence: Synthetic peptide
SLLMWITQC

SEQ ID NO: 2143 - protein, 9 aa, Artificial Sequence
  Description of Artificial Sequence: Synthetic peptide
KTWGQYWQV

SEQ ID NO: 2144 - protein, 9 aa, Artificial Sequence
  Description of Artificial Sequence: Synthetic peptide
YLEPGPVTA

SEQ ID NO: 2145 - protein, 9 aa, Artificial Sequence
  Description of Artificial Sequence: Synthetic peptide
YMDGTMSQV

SEQ ID NO: 2146 - protein, 9 aa, Artificial Sequence
  Description of Artificial Sequence: Synthetic peptide
YLSGANLNL

SEQ ID NO: 2147 - protein, 10 aa, Artificial Sequence
  Description of Artificial Sequence: Synthetic peptide
ELAGIGILTV

SEQ ID NO: 2148 - protein, 9 aa, Artificial Sequence
  Description of Artificial Sequence: Synthetic peptide
ILAKFLHWL

SEQ ID NO: 2149 - protein, 9 aa, Artificial Sequence
  Description of Artificial Sequence: Synthetic peptide
ALQPGTALL

SEQ ID NO: 2150 - protein, 10 aa, Artificial Sequence
  Description of Artificial Sequence: Synthetic peptide
VISNDVCAQV

SEQ ID NO: 2151 - protein, 9 aa, Artificial Sequence
  Description of Artificial Sequence: Synthetic peptide
RLVDDFLLV

SEQ ID NO: 2152 - protein, 9 aa, Artificial Sequence
  Description of Artificial Sequence: Synthetic peptide
GVLVGVALI

SEQ ID NO: 2153 - protein, 10 aa, Artificial Sequence
  Description of Artificial Sequence: Synthetic peptide
VLYRYGSFSV

SEQ ID NO: 2154 - protein, 9 aa, Artificial Sequence
  Description of Artificial Sequence: Synthetic peptide
PLFQVPEPV

SEQ ID NO: 2155 - protein, 9 aa, Artificial Sequence
  Description of Artificial Sequence: Synthetic peptide
FMNKFIYEI

SEQ ID NO: 2156 - protein, 10 aa, Artificial Sequence
  Description of Artificial Sequence: Synthetic peptide
GLSPNLNRFL

SEQ ID NO: 2157 - protein, 9 aa, Artificial Sequence
  Description of Artificial Sequence: Synthetic peptide
KVLEYVIKV

SEQ ID NO: 2158 - protein, 9 aa, Artificial Sequence
  Description of Artificial Sequence: Synthetic peptide
LLGRNSFEV

SEQ ID NO: 2159 - protein, 9 aa, Artificial Sequence
  Description of Artificial Sequence: Synthetic peptide
LLLLTVLTV

SEQ ID NO: 2160 - protein, 9 aa, Artificial Sequence
  Description of Artificial Sequence: Synthetic peptide
ILHNGAYSL

SEQ ID NO: 2161 - protein, 9 aa, Artificial Sequence
  Description of Artificial Sequence: Synthetic peptide
RLLQETELV

SEQ ID NO: 2162 - protein, 9 aa, Artificial Sequence
  Description of Artificial Sequence: Synthetic peptide
KIFGSLAFL

SEQ ID NO: 2163 - protein, 9 aa, Artificial Sequence
  Description of Artificial Sequence: Synthetic peptide
LLLLDVAPL

SEQ ID NO: 2164 - protein, 9 aa, Artificial Sequence
  Description of Artificial Sequence: Synthetic peptide
LLDVAPLSL

SEQ ID NO: 2165 - protein, 9 aa, Artificial Sequence
  Description of Artificial Sequence: Synthetic peptide
HLYQGCQVV

SEQ ID NO: 2166 - protein, 9 aa, Artificial Sequence
  Description of Artificial Sequence: Synthetic peptide
HLSTAFARV

SEQ ID NO: 2167 - protein, 9 aa, Artificial Sequence
  Description of Artificial Sequence: Synthetic peptide
VLQELNVTV

SEQ ID NO: 2168 - protein, 9 aa, Artificial Sequence
  Description of Artificial Sequence: Synthetic peptide
KVAELVHFL

SEQ ID NO: 2169 - protein, 9 aa, Artificial Sequence
  Description of Artificial Sequence: Synthetic peptide
VLAGVGFFI

SEQ ID NO: 2170 - protein, 9 aa, Artificial Sequence
  Description of Artificial Sequence: Synthetic peptide
FLYTLLREV

SEQ ID NO: 2171 - protein, 9 aa, Artificial Sequence
  Description of Artificial Sequence: Synthetic peptide
ILLWQPIPV

SEQ ID NO: 2172 - protein, 10 aa, Artificial Sequence
  Description of Artificial Sequence: Synthetic peptide
RLQEERTCKV

SEQ ID NO: 2173 - protein, 10 aa, Artificial Sequence
  Description of Artificial Sequence: Synthetic peptide
QLCPICRAPV

SEQ ID NO: 2174 - protein, 10 aa, Artificial Sequence
  Description of Artificial Sequence: Synthetic peptide
VLGEAWRDQV

SEQ ID NO: 2175 - protein, 9 aa, Artificial Sequence
  Description of Artificial Sequence: Synthetic peptide
LLLTVLTVV

SEQ ID NO: 2176 - protein, 9 aa, Artificial Sequence
  Description of Artificial Sequence: Synthetic peptide
GLYDGMEHL

SEQ ID NO: 2177 - protein, 9 aa, Artificial Sequence
  Description of Artificial Sequence: Synthetic peptide
SLLMWITQV

SEQ ID NO: 2178 - protein, 9 aa, Artificial Sequence
  Description of Artificial Sequence: Synthetic peptide
LMLGEFLKL

SEQ ID NO: 2179 - protein, 9 aa, Artificial Sequence
  Description of Artificial Sequence: Synthetic peptide
YLFFYRKSV

SEQ ID NO: 2180 - protein, 10 aa, Artificial Sequence
  Description of Artificial Sequence: Synthetic peptide
ELTLGEFLKL

SEQ ID NO: 2181 - protein, 10 aa, Artificial Sequence
  Description of Artificial Sequence: Synthetic peptide
FLTPKKLQCV

SEQ ID NO: 2182 - protein, 9 aa, Artificial Sequence
  Description of Artificial Sequence: Synthetic peptide
KLQCVDLHV

SEQ ID NO: 2183 - protein, 9 aa, Artificial Sequence
  Description of Artificial Sequence: Synthetic peptide
TLAPATEPA

SEQ ID NO: 2184 - protein, 10 aa, Artificial Sequence
  Description of Artificial Sequence: Synthetic peptide
YLQVNSLQTV

SEQ ID NO: 2185 - protein, 9 aa, Artificial Sequence
  Description of Artificial Sequence: Synthetic peptide
SLGEQQYSV

SEQ ID NO: 2186 - protein, 9 aa, Artificial Sequence
  Description of Artificial Sequence: Synthetic peptide
SLEENIVIL

SEQ ID NO: 2187 - protein, 9 aa, Artificial Sequence
  Description of Artificial Sequence: Synthetic peptide
YMNGTMSQV

SEQ ID NO: 2188 - protein, 9 aa, Artificial Sequence
  Description of Artificial Sequence: Synthetic peptide
ILSLELMKL

SEQ ID NO: 2189 - protein, 10 aa, Artificial Sequence
  Description of Artificial Sequence: Synthetic peptide
PLFDFSWLSL

SEQ ID NO: 2190 - protein, 9 aa, Artificial Sequence
  Description of Artificial Sequence: Synthetic peptide
LLGATCMFV

SEQ ID NO: 2191 - protein, 10 aa, Artificial Sequence
  Description of Artificial Sequence: Synthetic peptide
ALYVDSLFFL

SEQ ID NO: 2192 - protein, 9 aa, Artificial Sequence
  Description of Artificial Sequence: Synthetic peptide
GLMEEMSAL

SEQ ID NO: 2193 - protein, 9 aa, Artificial Sequence
  Description of Artificial Sequence: Synthetic peptide
TMNGSKSPV

SEQ ID NO: 2194 - protein, 10 aa, Artificial Sequence
  Description of Artificial Sequence: Synthetic peptide
GVYDGREHTV

SEQ ID NO: 2195 - protein, 10 aa, Artificial Sequence
  Description of Artificial Sequence: Synthetic peptide
YLNDHLEPWI

SEQ ID NO: 2196 - protein, 9 aa, Artificial Sequence
  Description of Artificial Sequence: Synthetic peptide
ALDVYNGLL

SEQ ID NO: 2197 - protein, 9 aa, Artificial Sequence
  Description of Artificial Sequence: Synthetic peptide
ALFDIESKV

SEQ ID NO: 2198 - protein, 10 aa, Artificial Sequence
  Description of Artificial Sequence: Synthetic peptide
SLAMLDLLHV

SEQ ID NO: 2199 - protein, 10 aa, Artificial Sequence
  Description of Artificial Sequence: Synthetic peptide
YLNTVQPTCV

SEQ ID NO: 2200 - protein, 10 aa, Artificial Sequence
  Description of Artificial Sequence: Synthetic peptide
KLFGTSGQKT

SEQ ID NO: 2201 - protein, 9 aa, Artificial Sequence
  Description of Artificial Sequence: Synthetic peptide
RMPEAAPPV

SEQ ID NO: 2202 - protein, 9 aa, Artificial Sequence
  Description of Artificial Sequence: Synthetic peptide
PLTSIISAV

SEQ ID NO: 2203 - protein, 9 aa, Artificial Sequence
  Description of Artificial Sequence: Synthetic peptide
VLAGGFFLL

SEQ ID NO: 2204 - protein, 9 aa, Artificial Sequence
  Description of Artificial Sequence: Synthetic peptide
LLHETDSAV

SEQ ID NO: 2205 - protein, 10 aa, Artificial Sequence
  Description of Artificial Sequence: Synthetic peptide
VMAGVGSPYV

SEQ ID NO: 2206 - protein, 9 aa, Artificial Sequence
  Description of Artificial Sequence: Synthetic peptide
VLPLTVAEV

SEQ ID NO: 2207 - protein, 9 aa, Artificial Sequence
  Description of Artificial Sequence: Synthetic peptide
SLLFLLFSL

SEQ ID NO: 2208 - protein, 9 aa, Artificial Sequence
  Description of Artificial Sequence: Synthetic peptide
QLFEELQEL

SEQ ID NO: 2209 - protein, 9 aa, Artificial Sequence
  Description of Artificial Sequence: Synthetic peptide
VLDGLDVLL

SEQ ID NO: 2210 - protein, 10 aa, Artificial Sequence
  Description of Artificial Sequence: Synthetic peptide
RLASFYDWPL

SEQ ID NO: 2211 - protein, 10 aa, Artificial Sequence
  Description of Artificial Sequence: Synthetic peptide
LIAHNQVRQV

SEQ ID NO: 2212 - protein, 9 aa, Artificial Sequence
  Description of Artificial Sequence: Synthetic peptide
ILHDGAYSL

SEQ ID NO: 2213 - protein, 9 aa, Artificial Sequence
  Description of Artificial Sequence: Synthetic peptide
FVGEFFTDV

SEQ ID NO: 2214 - protein, 9 aa, Artificial Sequence
  Description of Artificial Sequence: Synthetic peptide
LLLIWFRPV

SEQ ID NO: 2215 - protein, 9 aa, Artificial Sequence
  Description of Artificial Sequence: Synthetic peptide
KLQDASAEV

SEQ ID NO: 2216 - protein, 10 aa, Artificial Sequence
  Description of Artificial Sequence: Synthetic peptide
SLYSFPEPEA

SEQ ID NO: 2217 - protein, 9 aa, Artificial Sequence
  Description of Artificial Sequence: Synthetic peptide
SLLQHLIGL

SEQ ID NO: 2218 - protein, 9 aa, Artificial Sequence
  Description of Artificial Sequence: Synthetic peptide
VIFDFLHCI

SEQ ID NO: 2219 - protein, 9 aa, Artificial Sequence
  Description of Artificial Sequence: Synthetic peptide
VLDFAPPGA

SEQ ID NO: 2220 - protein, 9 aa, Artificial Sequence
  Description of Artificial Sequence: Synthetic peptide
TLPGYPPHV

SEQ ID NO: 2221 - protein, 10 aa, Artificial Sequence
  Description of Artificial Sequence: Synthetic peptide
YMEHNNVYTV

SEQ ID NO: 2222 - protein, 10 aa, Artificial Sequence
  Description of Artificial Sequence: Synthetic peptide
YLQHNEIQEV

SEQ ID NO: 2223 - protein, 9 aa, Artificial Sequence
  Description of Artificial Sequence: Synthetic peptide
SLVDVMPWL

SEQ ID NO: 2224 - protein, 9 aa, Artificial Sequence
  Description of Artificial Sequence: Synthetic peptide
RLMNDMTAV

SEQ ID NO: 2225 - protein, 9 aa, Artificial Sequence
  Description of Artificial Sequence: Synthetic peptide
RLARLALVL

SEQ ID NO: 2226 - protein, 9 aa, Artificial Sequence
  Description of Artificial Sequence: Synthetic peptide
FLTGNQLAV

SEQ ID NO: 2227 - protein, 9 aa, Artificial Sequence
  Description of Artificial Sequence: Synthetic peptide
LLLAGLFSL

SEQ ID NO: 2228 - protein, 9 aa, Artificial Sequence
  Description of Artificial Sequence: Synthetic peptide
FLGYLILGV

SEQ ID NO: 2229 - protein, 9 aa, Artificial Sequence
  Description of Artificial Sequence: Synthetic peptide
SLFLGILSV

SEQ ID NO: 2230 - protein, 9 aa, Artificial Sequence
  Description of Artificial Sequence: Synthetic peptide
AVLPLLELV

SEQ ID NO: 2231 - protein, 9 aa, Artificial Sequence
  Description of Artificial Sequence: Synthetic peptide
SLSEKTVLL

SEQ ID NO: 2232 - protein, 9 aa, Artificial Sequence
  Description of Artificial Sequence: Synthetic peptide
YMCSFLFNL

SEQ ID NO: 2233 - protein, 9 aa, Artificial Sequence
  Description of Artificial Sequence: Synthetic peptide
YLISGDSPV

SEQ ID NO: 2234 - protein, 9 aa, Artificial Sequence
  Description of Artificial Sequence: Synthetic peptide
KASEKIFYV

SEQ ID NO: 2235 - protein, 9 aa, Artificial Sequence
  Description of Artificial Sequence: Synthetic peptide
FLAKLNNTV

SEQ ID NO: 2236 - protein, 11 aa, Artificial Sequence
  Description of Artificial Sequence: Synthetic peptide
GLAPPQHLIRV

SEQ ID NO: 2237 - protein, 9 aa, Artificial Sequence
  Description of Artificial Sequence: Synthetic peptide
VIMPCSWWV

SEQ ID NO: 2238 - protein, 9 aa, Artificial Sequence
  Description of Artificial Sequence: Synthetic peptide
KVVEFLAML

SEQ ID NO: 2239 - protein, 9 aa, Artificial Sequence
  Description of Artificial Sequence: Synthetic peptide
LTLGEFLKL

SEQ ID NO: 2240 - protein, 9 aa, Artificial Sequence
  Description of Artificial Sequence: Synthetic peptide
ALPFGFILV

SEQ ID NO: 2241 - protein, 9 aa, Artificial Sequence
  Description of Artificial Sequence: Synthetic peptide
TLADFDPRV

SEQ ID NO: 2242 - protein, 9 aa, Artificial Sequence
  Description of Artificial Sequence: Synthetic peptide
ALMEQQHYV

SEQ ID NO: 2243 - protein, 9 aa, Artificial Sequence
  Description of Artificial Sequence: Synthetic peptide
CLTSTVQLV

SEQ ID NO: 2244 - protein, 10 aa, Artificial Sequence
  Description of Artificial Sequence: Synthetic peptide
GLLGASVLGL

SEQ ID NO: 2245 - protein, 10 aa, Artificial Sequence
  Description of Artificial Sequence: Synthetic peptide
QLLDGFMITL

SEQ ID NO: 2246 - protein, 9 aa, Artificial Sequence
  Description of Artificial Sequence: Synthetic peptide
YLVGNVCIL

SEQ ID NO: 2247 - protein, 10 aa, Artificial Sequence
  Description of Artificial Sequence: Synthetic peptide
ALLTSRLRFI

SEQ ID NO: 2248 - protein, 9 aa, Artificial Sequence
  Description of Artificial Sequence: Synthetic peptide
RLSSCVPVA

SEQ ID NO: 2249 - protein, 9 aa, Artificial Sequence
  Description of Artificial Sequence: Synthetic peptide
FLYDDNQRV

SEQ ID NO: 2250 - protein, 9 aa, Artificial Sequence
  Description of Artificial Sequence: Synthetic peptide
YLIELIDRV

SEQ ID NO: 2251 - protein, 10 aa, Artificial Sequence
  Description of Artificial Sequence: Synthetic peptide
FLAEDALNTV

SEQ ID NO: 2252 - protein, 9 aa, Artificial Sequence
  Description of Artificial Sequence: Synthetic peptide
GLMKYIGEV

SEQ ID NO: 2253 - protein, 9 aa, Artificial Sequence
  Description of Artificial Sequence: Synthetic peptide
AILALLPAL

SEQ ID NO: 2254 - protein, 9 aa, Artificial Sequence
  Description of Artificial Sequence: Synthetic peptide
GLQHWVPEL

SEQ ID NO: 2255 - protein, 9 aa, Artificial Sequence
  Description of Artificial Sequence: Synthetic peptide
GVRGRVEEI

SEQ ID NO: 2256 - protein, 9 aa, Artificial Sequence
  Description of Artificial Sequence: Synthetic peptide
ITDQVPFSV

SEQ ID NO: 2257 - protein, 9 aa, Artificial Sequence
  Description of Artificial Sequence: Synthetic peptide
KLCPVQLWV

SEQ ID NO: 2258 - protein, 10 aa, Artificial Sequence
  Description of Artificial Sequence: Synthetic peptide
KVAEELVHFL

SEQ ID NO: 2259 - protein, 9 aa, Artificial Sequence
  Description of Artificial Sequence: Synthetic peptide
SLPPPGTRV

SEQ ID NO: 2260 - protein, 9 aa, Artificial Sequence
  Description of Artificial Sequence: Synthetic peptide
YLGSYGFRL

SEQ ID NO: 2261 - protein, 10 aa, Artificial Sequence
  Description of Artificial Sequence: Synthetic peptide
YLQLVFGIEV

SEQ ID NO: 2262 - protein, 9 aa, Artificial Sequence
  Description of Artificial Sequence: Synthetic peptide
TLQDIVYKL

SEQ ID NO: 2263 - protein, 9 aa, Artificial Sequence
  Description of Artificial Sequence: Synthetic peptide
YAIDLPVSV

SEQ ID NO: 2264 - protein, 9 aa, Artificial Sequence
  Description of Artificial Sequence: Synthetic peptide
AMVGAVLTA

SEQ ID NO: 2265 - protein, 9 aa, Artificial Sequence
  Description of Artificial Sequence: Synthetic peptide
ATVGIMIGV

SEQ ID NO: 2266 - protein, 9 aa, Artificial Sequence
  Description of Artificial Sequence: Synthetic peptide
YVDPVITSI

SEQ ID NO: 2267 - protein, 10 aa, Artificial Sequence
  Description of Artificial Sequence: Synthetic peptide
GVLLWEIFSL

SEQ ID NO: 2268 - protein, 10 aa, Artificial Sequence
  Description of Artificial Sequence: Synthetic peptide
LMAQEALAFL

SEQ ID NO: 2269 - protein, 9 aa, Artificial Sequence
  Description of Artificial Sequence: Synthetic peptide
  MOD_RES (4)..(4): Phospho-Ser
RVASPTSGV

SEQ ID NO: 2270 - protein, 9 aa, Artificial Sequence
  Description of Artificial Sequence: Synthetic peptide
RVASPTSGV

SEQ ID NO: 2271 - protein, 9 aa, Artificial Sequence
  Description of Artificial Sequence: Synthetic peptide
ALNVYNGLL

SEQ ID NO: 2272 - protein, 9 aa, Artificial Sequence
  Description of Artificial Sequence: Synthetic peptide
ALSPVPPVV

SEQ ID NO: 2273 - protein, 9 aa, Artificial Sequence
  Description of Artificial Sequence: Synthetic peptide
ALVCYGPGI

SEQ ID NO: 2274 - protein, 10 aa, Artificial Sequence
  Description of Artificial Sequence: Synthetic peptide
ALWPWLLMAT

SEQ ID NO: 2275 - protein, 9 aa, Artificial Sequence
  Description of Artificial Sequence: Synthetic peptide
ALYLMELTM

SEQ ID NO: 2276 - protein, 9 aa, Artificial Sequence
  Description of Artificial Sequence: Synthetic peptide
CLPSPSTPV

SEQ ID NO: 2277 - protein, 9 aa, Artificial Sequence
  Description of Artificial Sequence: Synthetic peptide
ELSDSLGPV

SEQ ID NO: 2278 - protein, 9 aa, Artificial Sequence
  Description of Artificial Sequence: Synthetic peptide
FLFLRNFSL

SEQ ID NO: 2279 - protein, 10 aa, Artificial Sequence
  Description of Artificial Sequence: Synthetic peptide
FLPSPLFFFL

SEQ ID NO: 2280 - protein, 9 aa, Artificial Sequence
  Description of Artificial Sequence: Synthetic peptide
GLFKCGIAV

SEQ ID NO: 2281 - protein, 9 aa, Artificial Sequence
  Description of Artificial Sequence: Synthetic peptide
GLIQLVEGV

SEQ ID NO: 2282 - protein, 9 aa, Artificial Sequence
  Description of Artificial Sequence: Synthetic peptide
ILGVLTSLV

SEQ ID NO: 2283 - protein, 10 aa, Artificial Sequence
  Description of Artificial Sequence: Synthetic peptide
LLVPTCVFLV

SEQ ID NO: 2284 - protein, 9 aa, Artificial Sequence
  Description of Artificial Sequence: Synthetic peptide
MLAVFLPIV

SEQ ID NO: 2285 - protein, 9 aa, Artificial Sequence
  Description of Artificial Sequence: Synthetic peptide
NLFETPVEA

SEQ ID NO: 2286 - protein, 9 aa, Artificial Sequence
  Description of Artificial Sequence: Synthetic peptide
QLGEQCWTV

SEQ ID NO: 2287 - protein, 9 aa, Artificial Sequence
  Description of Artificial Sequence: Synthetic peptide
RLAEYQAYI

SEQ ID NO: 2288 - protein, 9 aa, Artificial Sequence
  Description of Artificial Sequence: Synthetic peptide
SIDWFMVTV

SEQ ID NO: 2289 - protein, 10 aa, Artificial Sequence
  Description of Artificial Sequence: Synthetic peptide
SILLRDAGLV

SEQ ID NO: 2290 - protein, 9 aa, Artificial Sequence
  Description of Artificial Sequence: Synthetic peptide
SLFEPPPPG

SEQ ID NO: 2291 - protein, 9 aa, Artificial Sequence
  Description of Artificial Sequence: Synthetic peptide
SQADALKYV

SEQ ID NO: 2292 - protein, 10 aa, Artificial Sequence
  Description of Artificial Sequence: Synthetic peptide
WLSLKTLLSL

SEQ ID NO: 2293 - protein, 10 aa, Artificial Sequence
  Description of Artificial Sequence: Synthetic peptide
YLNRHLHTWI

SEQ ID NO: 2294 - protein, 9 aa, Artificial Sequence
  Description of Artificial Sequence: Synthetic peptide
YLQWIEFSI

SEQ ID NO: 2295 - protein, 10 aa, Artificial Sequence
  Description of Artificial Sequence: Synthetic peptide
YLYQWLGAPV

SEQ ID NO: 2296 - protein, 10 aa, Artificial Sequence
  Description of Artificial Sequence: Synthetic peptide
KLMSSNSTDL

SEQ ID NO: 2297 - protein, 9 aa, Artificial Sequence
  Description of Artificial Sequence: Synthetic peptide
RLQGISPKI

SEQ ID NO: 2298 - protein, 10 aa, Artificial Sequence
  Description of Artificial Sequence: Synthetic peptide
AILALLPALL

SEQ ID NO: 2299 - protein, 9 aa, Artificial Sequence
  Description of Artificial Sequence: Synthetic peptide
ALIHHNTHL

SEQ ID NO: 2300 - protein, 9 aa, Artificial Sequence
  Description of Artificial Sequence: Synthetic peptide
CMHLLLEAV

SEQ ID NO: 2301 - protein, 9 aa, Artificial Sequence
  Description of Artificial Sequence: Synthetic peptide
FLIIWQNTM

SEQ ID NO: 2302 - protein, 10 aa, Artificial Sequence
  Description of Artificial Sequence: Synthetic peptide
FLPWHRLFLL

SEQ ID NO: 2303 - protein, 9 aa, Artificial Sequence
  Description of Artificial Sequence: Synthetic peptide
FVWLHYYSV

SEQ ID NO: 2304 - protein, 9 aa, Artificial Sequence
  Description of Artificial Sequence: Synthetic peptide
GLFGDIYLA

SEQ ID NO: 2305 - protein, 10 aa, Artificial Sequence
  Description of Artificial Sequence: Synthetic peptide
GLFGDIYLAI

SEQ ID NO: 2306 - protein, 9 aa, Artificial Sequence
  Description of Artificial Sequence: Synthetic peptide
ILLRDAGLV

SEQ ID NO: 2307 - protein, 9 aa, Artificial Sequence
  Description of Artificial Sequence: Synthetic peptide
ILLVVVLGV

SEQ ID NO: 2308 - protein, 9 aa, Artificial Sequence
  Description of Artificial Sequence: Synthetic peptide
ILNAMIAKI

SEQ ID NO: 2309 - protein, 9 aa, Artificial Sequence
  Description of Artificial Sequence: Synthetic peptide
KASEYLQLV

SEQ ID NO: 2310 - protein, 9 aa, Artificial Sequence
  Description of Artificial Sequence: Synthetic peptide
KIWEELSVL

SEQ ID NO: 2311 - protein, 9 aa, Artificial Sequence
  Description of Artificial Sequence: Synthetic peptide
KLIDRTESL

SEQ ID NO: 2312 - protein, 10 aa, Artificial Sequence
  Description of Artificial Sequence: Synthetic peptide
KLTGDENFTI

SEQ ID NO: 2313 - protein, 10 aa, Artificial Sequence
  Description of Artificial Sequence: Synthetic peptide
LLCYSCKAQV

SEQ ID NO: 2314 - protein, 9 aa, Artificial Sequence
  Description of Artificial Sequence: Synthetic peptide
LLLEAVPAV

SEQ ID NO: 2315 - protein, 9 aa, Artificial Sequence
  Description of Artificial Sequence: Synthetic peptide
LLNQLQVNL

SEQ ID NO: 2316 - protein, 10 aa, Artificial Sequence
  Description of Artificial Sequence: Synthetic peptide
LLRDAGLVKM

SEQ ID NO: 2317 - protein, 10 aa, Artificial Sequence
  Description of Artificial Sequence: Synthetic peptide
LLRRYNVAKV

SEQ ID NO: 2318 - protein, 10 aa, Artificial Sequence
  Description of Artificial Sequence: Synthetic peptide
LLSHGAVIEV

SEQ ID NO: 2319 - protein, 10 aa, Artificial Sequence
  Description of Artificial Sequence: Synthetic peptide
LVFGIELMEV

SEQ ID NO: 2320 - protein, 10 aa, Artificial Sequence
  Description of Artificial Sequence: Synthetic peptide
LVFGIEVVEV

SEQ ID NO: 2321 - protein, 9 aa, Artificial Sequence
  Description of Artificial Sequence: Synthetic peptide
MLWGWREHV

SEQ ID NO: 2322 - protein, 9 aa, Artificial Sequence
  Description of Artificial Sequence: Synthetic peptide
PLQPEQLQV

SEQ ID NO: 2323 - protein, 9 aa, Artificial Sequence
  Description of Artificial Sequence: Synthetic peptide
QLMAFNHLI

SEQ ID NO: 2324 - protein, 9 aa, Artificial Sequence
  Description of Artificial Sequence: Synthetic peptide
QLMPYGCLL

SEQ ID NO: 2325 - protein, 9 aa, Artificial Sequence
  Description of Artificial Sequence: Synthetic peptide
RLGPTLMCL

SEQ ID NO: 2326 - protein, 9 aa, Artificial Sequence
  Description of Artificial Sequence: Synthetic peptide
RLTRFLSRV

SEQ ID NO: 2327 - protein, 9 aa, Artificial Sequence
  Description of Artificial Sequence: Synthetic peptide
RTFSPTYGL

SEQ ID NO: 2328 - protein, 9 aa, Artificial Sequence
  Description of Artificial Sequence: Synthetic peptide
SILLRDAGL

SEQ ID NO: 2329 - protein, 10 aa, Artificial Sequence
  Description of Artificial Sequence: Synthetic peptide
SLADEAEVYL

SEQ ID NO: 2330 - protein, 9 aa, Artificial Sequence
  Description of Artificial Sequence: Synthetic peptide
SLDDYNHLV

SEQ ID NO: 2331 - protein, 10 aa, Artificial Sequence
  Description of Artificial Sequence: Synthetic peptide
SLYKFSPFPL

SEQ ID NO: 2332 - protein, 9 aa, Artificial Sequence
  Description of Artificial Sequence: Synthetic peptide
SMTRSPPRV

SEQ ID NO: 2333 - protein, 9 aa, Artificial Sequence
  Description of Artificial Sequence: Synthetic peptide
TLEEITGYL

SEQ ID NO: 2334 - protein, 9 aa, Artificial Sequence
  Description of Artificial Sequence: Synthetic peptide
TLHCDCEIL

SEQ ID NO: 2335 - protein, 10 aa, Artificial Sequence
  Description of Artificial Sequence: Synthetic peptide
VLEPPGARDV

SEQ ID NO: 2336 - protein, 10 aa, Artificial Sequence
  Description of Artificial Sequence: Synthetic peptide
VLLALLMAGL

SEQ ID NO: 2337 - protein, 9 aa, Artificial Sequence
  Description of Artificial Sequence: Synthetic peptide
VLSVNVPDV

SEQ ID NO: 2338 - protein, 9 aa, Artificial Sequence
  Description of Artificial Sequence: Synthetic peptide
VLVKSPNHV

SEQ ID NO: 2339 - protein, 9 aa, Artificial Sequence
  Description of Artificial Sequence: Synthetic peptide
VMIGSPKKV

SEQ ID NO: 2340 - protein, 9 aa, Artificial Sequence
  Description of Artificial Sequence: Synthetic peptide
VVLGVVFGI

SEQ ID NO: 2341 - protein, 9 aa, Artificial Sequence
  Description of Artificial Sequence: Synthetic peptide
WLPKILGEV

SEQ ID NO: 2342 - protein, 9 aa, Artificial Sequence
  Description of Artificial Sequence: Synthetic peptide
WLQYFPNPV

SEQ ID NO: 2343 - protein, 10 aa, Artificial Sequence
  Description of Artificial Sequence: Synthetic peptide
YLLDLSTNHL

SEQ ID NO: 2344 - protein, 10 aa, Artificial Sequence
  Description of Artificial Sequence: Synthetic peptide
YLWWVNNQSL

SEQ ID NO: 2345 - protein, 10 aa, Artificial Sequence
  Description of Artificial Sequence: Synthetic peptide
ALGGHPLLGV

SEQ ID NO: 2346 - protein, 9 aa, Artificial Sequence
  Description of Artificial Sequence: Synthetic peptide
ALLAGLVSL

SEQ ID NO: 2347 - protein, 10 aa, Artificial Sequence
  Description of Artificial Sequence: Synthetic peptide
ALLTYMIAHI

SEQ ID NO: 2348 - protein, 9 aa, Artificial Sequence
  Description of Artificial Sequence: Synthetic peptide
ALMDKSLHV

SEQ ID NO: 2349 - protein, 9 aa, Artificial Sequence
  Description of Artificial Sequence: Synthetic peptide
ALPPPLMLL

SEQ ID NO: 2350 - protein, 9 aa, Artificial Sequence
  Description of Artificial Sequence: Synthetic peptide
ALSVMGVYV

SEQ ID NO: 2351 - protein, 9 aa, Artificial Sequence
  Description of Artificial Sequence: Synthetic peptide
ALVEFEDVL

SEQ ID NO: 2352 - protein, 9 aa, Artificial Sequence
  Description of Artificial Sequence: Synthetic peptide
ALWPWLLMA

SEQ ID NO: 2353 - protein, 10 aa, Artificial Sequence
  Description of Artificial Sequence: Synthetic peptide
AMLGTHTMEV

SEQ ID NO: 2354 - protein, 9 aa, Artificial Sequence
  Description of Artificial Sequence: Synthetic peptide
AVIGALLAV

SEQ ID NO: 2355 - protein, 9 aa, Artificial Sequence
  Description of Artificial Sequence: Synthetic peptide
CLYGNVEKV

SEQ ID NO: 2356 - protein, 9 aa, Artificial Sequence
  Description of Artificial Sequence: Synthetic peptide
DLIFGLNAL

SEQ ID NO: 2357 - protein, 9 aa, Artificial Sequence
  Description of Artificial Sequence: Synthetic peptide
ELFQDLSQL

SEQ ID NO: 2358 - protein, 9 aa, Artificial Sequence
  Description of Artificial Sequence: Synthetic peptide
FAWERVRGL

SEQ ID NO: 2359 - protein, 10 aa, Artificial Sequence
  Description of Artificial Sequence: Synthetic peptide
FIASNGVKLV

SEQ ID NO: 2360 - protein, 9 aa, Artificial Sequence
  Description of Artificial Sequence: Synthetic peptide
FLALIICNA

SEQ ID NO: 2361 - protein, 9 aa, Artificial Sequence
  Description of Artificial Sequence: Synthetic peptide
FLDEFMEGV

SEQ ID NO: 2362 - protein, 9 aa, Artificial Sequence
  Description of Artificial Sequence: Synthetic peptide
RMFPNAPYL

SEQ ID NO: 2363 - protein, 9 aa, Artificial Sequence
  Description of Artificial Sequence: Synthetic peptide
RLNMFTPYI

SEQ ID NO: 2364 - protein, 9 aa, Artificial Sequence
  Description of Artificial Sequence: Synthetic peptide
NMFTPYIGV

SEQ ID NO: 2365 - protein, 9 aa, Artificial Sequence
  Description of Artificial Sequence: Synthetic peptide
NLVPMVATV

SEQ ID NO: 2366 - protein, 9 aa, Artificial Sequence
  Description of Artificial Sequence: Synthetic peptide
VLEETSVML

SEQ ID NO: 2367 - protein, 9 aa, Artificial Sequence
  Description of Artificial Sequence: Synthetic peptide
VLAELVKQI

SEQ ID NO: 2368 - protein, 9 aa, Artificial Sequence
  Description of Artificial Sequence: Synthetic peptide
MLNIPSINV

SEQ ID NO: 2369 - protein, 9 aa, Artificial Sequence
  Description of Artificial Sequence: Synthetic peptide
LLLDRLNQL

SEQ ID NO: 2370 - protein, 9 aa, Artificial Sequence
  Description of Artificial Sequence: Synthetic peptide
FIAGLIAIV

SEQ ID NO: 2371 - protein, 9 aa, Artificial Sequence
  Description of Artificial Sequence: Synthetic peptide
ALNTLVKQL

SEQ ID NO: 2372 - protein, 9 aa, Artificial Sequence
  Description of Artificial Sequence: Synthetic peptide
LITGRLQSL

SEQ ID NO: 2373 - protein, 9 aa, Artificial Sequence
  Description of Artificial Sequence: Synthetic peptide
NLNESLIDL

SEQ ID NO: 2374 - protein, 9 aa, Artificial Sequence
  Description of Artificial Sequence: Synthetic peptide
VLNDILSRL

SEQ ID NO: 2375 - protein, 9 aa, Artificial Sequence
  Description of Artificial Sequence: Synthetic peptide
YLQPRTFLL

SEQ ID NO: 2376 - protein, 9 aa, Artificial Sequence
  Description of Artificial Sequence: Synthetic peptide
LLYDANYFL

SEQ ID NO: 2377 - protein, 9 aa, Artificial Sequence
  Description of Artificial Sequence: Synthetic peptide
RLQSLQTYV

SEQ ID NO: 2378 - protein, 9 aa, Artificial Sequence
  Description of Artificial Sequence: Synthetic peptide
KLWAQCVQL

SEQ ID NO: 2379 - protein, 9 aa, Artificial Sequence
  Description of Artificial Sequence: Synthetic peptide
TLYAVATTI

SEQ ID NO: 2380 - protein, 9 aa, Artificial Sequence
  Description of Artificial Sequence: Synthetic peptide
KLAEAIFKL

SEQ ID NO: 2381 - protein, 10 aa, Artificial Sequence
  Description of Artificial Sequence: Synthetic peptide
ILIRTGLLVI

SEQ ID NO: 2382 - protein, 9 aa, Artificial Sequence
  Description of Artificial Sequence: Synthetic peptide
AIKRGLRTL

SEQ ID NO: 2383 - protein, 9 aa, Artificial Sequence
  Description of Artificial Sequence: Synthetic peptide
LLLGLMILL

SEQ ID NO: 2384 - protein, 9 aa, Artificial Sequence
  Description of Artificial Sequence: Synthetic peptide
VLLLVTHYA

SEQ ID NO: 2385 - protein, 9 aa, Artificial Sequence
  Description of Artificial Sequence: Synthetic peptide
GLCTLVAML

SEQ ID NO: 2386 - protein, 9 aa, Artificial Sequence
  Description of Artificial Sequence: Synthetic peptide
CLGGLLTMV

SEQ ID NO: 2387 - protein, 9 aa, Artificial Sequence
  Description of Artificial Sequence: Synthetic peptide
YLLEMLWRL

SEQ ID NO: 2388 - protein, 9 aa, Artificial Sequence
  Description of Artificial Sequence: Synthetic peptide
YLQQNWWTL

SEQ ID NO: 2389 - protein, 9 aa, Artificial Sequence
  Description of Artificial Sequence: Synthetic peptide
YVLDHLIVV

SEQ ID NO: 2390 - protein, 9 aa, Artificial Sequence
  Description of Artificial Sequence: Synthetic peptide
FLYALALLL

SEQ ID NO: 2391 - protein, 9 aa, Artificial Sequence
  Description of Artificial Sequence: Synthetic peptide
TLDYKPLSV

SEQ ID NO: 2392 - protein, 10 aa, Artificial Sequence
  Description of Artificial Sequence: Synthetic peptide
LLDFVRFMGV

SEQ ID NO: 2393 - protein, 9 aa, Artificial Sequence
  Description of Artificial Sequence: Synthetic peptide
FLDKGTYTL

SEQ ID NO: 2394 - protein, 10 aa, Artificial Sequence
  Description of Artificial Sequence: Synthetic peptide
FLPSDFFPSV

SEQ ID NO: 2395 - protein, 9 aa, Artificial Sequence
  Description of Artificial Sequence: Synthetic peptide
FLLTRILTI

SEQ ID NO: 2396 - protein, 10 aa, Artificial Sequence
  Description of Artificial Sequence: Synthetic peptide
GLSPTVWLSV

SEQ ID NO: 2397 - protein, 9 aa, Artificial Sequence
  Description of Artificial Sequence: Synthetic peptide
WLSLLVPFV

SEQ ID NO: 2398 - protein, 9 aa, Artificial Sequence
  Description of Artificial Sequence: Synthetic peptide
FLLSLGIHL

SEQ ID NO: 2399 - protein, 10 aa, Artificial Sequence
  Description of Artificial Sequence: Synthetic peptide
FLPSDFFPSI

SEQ ID NO: 2400 - protein, 9 aa, Artificial Sequence
  Description of Artificial Sequence: Synthetic peptide
VLHKRTLGL

SEQ ID NO: 2401 - protein, 9 aa, Artificial Sequence
  Description of Artificial Sequence: Synthetic peptide
GLSRYVARL

SEQ ID NO: 2402 - protein, 9 aa, Artificial Sequence
  Description of Artificial Sequence: Synthetic peptide
YMDDVVLGA

SEQ ID NO: 2403 - protein, 9 aa, Artificial Sequence
  Description of Artificial Sequence: Synthetic peptide
KLHLYSHPI

SEQ ID NO: 2404 - protein, 9 aa, Artificial Sequence
  Description of Artificial Sequence: Synthetic peptide
ELMTLATWV

SEQ ID NO: 2405 - protein, 9 aa, Artificial Sequence
  Description of Artificial Sequence: Synthetic peptide
DLMGYIPAV

SEQ ID NO: 2406 - protein, 9 aa, Artificial Sequence
  Description of Artificial Sequence: Synthetic peptide
CINGVCWTV

SEQ ID NO: 2407 - protein, 10 aa, Artificial Sequence
  Description of Artificial Sequence: Synthetic peptide
YLLPRRGPRL

SEQ ID NO: 2408 - protein, 9 aa, Artificial Sequence
  Description of Artificial Sequence: Synthetic peptide
VLSDFKTWL

SEQ ID NO: 2409 - protein, 9 aa, Artificial Sequence
  Description of Artificial Sequence: Synthetic peptide
ALYDVVTKL

SEQ ID NO: 2410 - protein, 10 aa, Artificial Sequence
  Description of Artificial Sequence: Synthetic peptide
KLVALGINAV

SEQ ID NO: 2411 - protein, 10 aa, Artificial Sequence
  Description of Artificial Sequence: Synthetic peptide
LLFNILGGWV

SEQ ID NO: 2412 - protein, 10 aa, Artificial Sequence
  Description of Artificial Sequence: Synthetic peptide
KLSGLGINAV

SEQ ID NO: 2413 - protein, 9 aa, Artificial Sequence
  Description of Artificial Sequence: Synthetic peptide
DLMGYIPLV

SEQ ID NO: 2414 - protein, 9 aa, Artificial Sequence
  Description of Artificial Sequence: Synthetic peptide
CVNGVCWTV

SEQ ID NO: 2415 - protein, 9 aa, Artificial Sequence
  Description of Artificial Sequence: Synthetic peptide
GLQDCTMLV

SEQ ID NO: 2416 - protein, 9 aa, Artificial Sequence
  Description of Artificial Sequence: Synthetic peptide
SLYNTVATL

SEQ ID NO: 2417 - protein, 9 aa, Artificial Sequence
  Description of Artificial Sequence: Synthetic peptide
ILKEPVHGV

SEQ ID NO: 2418 - protein, 9 aa, Artificial Sequence
  Description of Artificial Sequence: Synthetic peptide
TLNAWVKVV

SEQ ID NO: 2419 - protein, 9 aa, Artificial Sequence
  Description of Artificial Sequence: Synthetic peptide
KLTPLCVTL

SEQ ID NO: 2420 - protein, 9 aa, Artificial Sequence
  Description of Artificial Sequence: Synthetic peptide
GLADQLIHL

SEQ ID NO: 2421 - protein, 9 aa, Artificial Sequence
  Description of Artificial Sequence: Synthetic peptide
LTFGWCFKL

SEQ ID NO: 2422 - protein, 8 aa, Artificial Sequence
  Description of Artificial Sequence: Synthetic peptide
FLGKIWPS

SEQ ID NO: 2423 - protein, 9 aa, Artificial Sequence
  Description of Artificial Sequence: Synthetic peptide
ALVEMGHHA

SEQ ID NO: 2424 - protein, 9 aa, Artificial Sequence
  Description of Artificial Sequence: Synthetic peptide
RTLNAWVKV

SEQ ID NO: 2425 - protein, 9 aa, Artificial Sequence
  Description of Artificial Sequence: Synthetic peptide
NVWATHACV

SEQ ID NO: 2426 - protein, 10 aa, Artificial Sequence
  Description of Artificial Sequence: Synthetic peptide
SLLNATAIAV

SEQ ID NO: 2427 - protein, 9 aa, Artificial Sequence
  Description of Artificial Sequence: Synthetic peptide
SLFNTVATL

SEQ ID NO: 2428 - protein, 9 aa, Artificial Sequence
  Description of Artificial Sequence: Synthetic peptide
SLVKHHMYI

SEQ ID NO: 2429 - protein, 9 aa, Artificial Sequence
  Description of Artificial Sequence: Synthetic peptide
VIYHYVDDL

SEQ ID NO: 2430 - protein, 10 aa, Artificial Sequence
  Description of Artificial Sequence: Synthetic peptide
YMLDLQPETT

SEQ ID NO: 2431 - protein, 9 aa, Artificial Sequence
  Description of Artificial Sequence: Synthetic peptide
KLPQLCTEL

SEQ ID NO: 2432 - protein, 9 aa, Artificial Sequence
  Description of Artificial Sequence: Synthetic peptide
YMLDLQPET

SEQ ID NO: 2433 - protein, 9 aa, Artificial Sequence
  Description of Artificial Sequence: Synthetic peptide
MLDLQPETT

SEQ ID NO: 2434 - protein, 9 aa, Artificial Sequence
  Description of Artificial Sequence: Synthetic peptide
VLMIKALEL

SEQ ID NO: 2435 - protein, 9 aa, Artificial Sequence
  Description of Artificial Sequence: Synthetic peptide
QLFNHTMFI

SEQ ID NO: 2436 - protein, 9 aa, Artificial Sequence
  Description of Artificial Sequence: Synthetic peptide
QMARLAWEA

SEQ ID NO: 2437 - protein, 9 aa, Artificial Sequence
  Description of Artificial Sequence: Synthetic peptide
LLFGYPVYV

SEQ ID NO: 2438 - protein, 9 aa, Artificial Sequence
  Description of Artificial Sequence: Synthetic peptide
AVLDGLLSL

SEQ ID NO: 2439 - protein, 9 aa, Artificial Sequence
  Description of Artificial Sequence: Synthetic peptide
GLLSLEEEL

SEQ ID NO: 2440 - protein, 9 aa, Artificial Sequence
  Description of Artificial Sequence: Synthetic peptide
GILGFVFTL

SEQ ID NO: 2441 - protein, 10 aa, Artificial Sequence
  Description of Artificial Sequence: Synthetic peptide
ILGFVFTLTV

SEQ ID NO: 2442 - protein, 10 aa, Artificial Sequence
  Description of Artificial Sequence: Synthetic peptide
KLGEFYNQMM

SEQ ID NO: 2443 - protein, 9 aa, Artificial Sequence
  Description of Artificial Sequence: Synthetic peptide
SITEVECFL

SEQ ID NO: 2444 - protein, 9 aa, Artificial Sequence
  Description of Artificial Sequence: Synthetic peptide
ILMWEAVTL

SEQ ID NO: 2445 - protein, 9 aa, Artificial Sequence
  Description of Artificial Sequence: Synthetic peptide
ALPHIIDEV

SEQ ID NO: 2446 - protein, 9 aa, Artificial Sequence
  Description of Artificial Sequence: Synthetic peptide
YLVSIFLHL

SEQ ID NO: 2447 - protein, 9 aa, Artificial Sequence
  Description of Artificial Sequence: Synthetic peptide
SLNQTVHSL

SEQ ID NO: 2448 - protein, 9 aa, Artificial Sequence
  Description of Artificial Sequence: Synthetic peptide
YLNKIQNSL

SEQ ID NO: 2449 - protein, 9 aa, Artificial Sequence
  Description of Artificial Sequence: Synthetic peptide
FIDSYICQV

SEQ ID NO: 2450 - protein, 9 aa, Artificial Sequence
  Description of Artificial Sequence: Synthetic peptide
YIGEVLVSV

SEQ ID NO: 2451 - protein, 9 aa, Artificial Sequence
  Description of Artificial Sequence: Synthetic peptide
VLHDDLLEA

SEQ ID NO: 2452 - protein, 9 aa, Artificial Sequence
  Description of Artificial Sequence: Synthetic peptide
RTLDKVLEV

SEQ ID NO: 2453 - protein, 8 aa, Artificial Sequence
  Description of Artificial Sequence: Synthetic peptide
NEGATIVE

SEQ ID NO: 2454 - protein, 10 aa, Artificial Sequence
  Description of Artificial Sequence: Synthetic peptide
TMFPHIIVDV

SEQ ID NO: 2455 - protein, 9 aa, Artificial Sequence
  Description of Artificial Sequence: Synthetic peptide
LLDVPTAAV

SEQ ID NO: 2456 - protein, 9 aa, Artificial Sequence
  Description of Artificial Sequence: Synthetic peptide
RILGAVAKV

SEQ ID NO: 2457 - protein, 9 aa, Artificial Sequence
  Description of Artificial Sequence: Synthetic peptide
LMWYELSKI

SEQ ID NO: 2458 - protein, 9 aa, Artificial Sequence
  Description of Artificial Sequence: Synthetic peptide
ILEDIVLTL

SEQ ID NO: 2459 - protein, 9 aa, Artificial Sequence
  Description of Artificial Sequence: Synthetic peptide
KMLKEMGEV

SEQ ID NO: 2460 - protein, 9 aa, Artificial Sequence
  Description of Artificial Sequence: Synthetic peptide
KLIANNTRV

SEQ ID NO: 2461 - protein, 9 aa, Artificial Sequence
  Description of Artificial Sequence: Synthetic peptide
GLPVEYLQV

SEQ ID NO: 2462 - protein, 9 aa, Artificial Sequence
  Description of Artificial Sequence: Synthetic peptide
GILTVSVAV

SEQ ID NO: 2463 - protein, 9 aa, Artificial Sequence
  Description of Artificial Sequence: Synthetic peptide
AMASTEGNV

SEQ ID NO: 2464 - protein, 10 aa, Artificial Sequence
  Description of Artificial Sequence: Synthetic peptide
VLTDGNPPEV

SEQ ID NO: 2465 - protein, 9 aa, Artificial Sequence
  Description of Artificial Sequence: Synthetic peptide
KVDDTFYYV

SEQ ID NO: 2466 - protein, 9 aa, Artificial Sequence
  Description of Artificial Sequence: Synthetic peptide
ILDDNLYKV

SEQ ID NO: 2467 - protein, 9 aa, Artificial Sequence
  Description of Artificial Sequence: Synthetic peptide
ALWALPHAA

SEQ ID NO: 2468 - protein, 10 aa, Artificial Sequence
  Description of Artificial Sequence: Synthetic peptide
RLDDDGNFQL

SEQ ID NO: 2469 - protein, 9 aa, Artificial Sequence
  Description of Artificial Sequence: Synthetic peptide
ATWAENIQV

SEQ ID NO: 2470 - protein, 9 aa, Artificial Sequence
  Description of Artificial Sequence: Synthetic peptide
YTMDGEYRL

SEQ ID NO: 2471 - protein, 9 aa, Artificial Sequence
  Description of Artificial Sequence: Synthetic peptide
SVGGVFTSV

SEQ ID NO: 2472 - protein, 9 aa, Artificial Sequence
  Description of Artificial Sequence: Synthetic peptide
SLFGQRIEV

SEQ ID NO: 2473 - protein, 9 aa, Artificial Sequence
  Description of Artificial Sequence: Synthetic peptide
LLWNGPMAV

SEQ ID NO: 2474 - protein, 9 aa, Artificial Sequence
  Description of Artificial Sequence: Synthetic peptide
KQSSKALQR

SEQ ID NO: 2475 - protein, 9 aa, Artificial Sequence
  Description of Artificial Sequence: Synthetic peptide
ALLAVGATK

SEQ ID NO: 2476 - protein, 9 aa, Artificial Sequence
  Description of Artificial Sequence: Synthetic peptide
ATGFKQSSK

SEQ ID NO: 2477 - protein, 10 aa, Artificial Sequence
  Description of Artificial Sequence: Synthetic peptide
RISTFKNWPK

SEQ ID NO: 2478 - protein, 10 aa, Artificial Sequence
  Description of Artificial Sequence: Synthetic peptide
RLGLQVRKNK

SEQ ID NO: 2479 - protein, 9 aa, Artificial Sequence
  Description of Artificial Sequence: Synthetic peptide
RLLFFAPTR

SEQ ID NO: 2480 - protein, 9 aa, Artificial Sequence
  Description of Artificial Sequence: Synthetic peptide
QVLKKIAQK

SEQ ID NO: 2481 - protein, 9 aa, Artificial Sequence
  Description of Artificial Sequence: Synthetic peptide
RIAAWMATY

SEQ ID NO: 2482 - protein, 9 aa, Artificial Sequence
  Description of Artificial Sequence: Synthetic peptide
KLGGALQAK

SEQ ID NO: 2483 - protein, 9 aa, Artificial Sequence
  Description of Artificial Sequence: Synthetic peptide
KTFPPTEPK

SEQ ID NO: 2484 - protein, 9 aa, Artificial Sequence
  Description of Artificial Sequence: Synthetic peptide
ELERAADVK

SEQ ID NO: 2485 - protein, 10 aa, Artificial Sequence
  Description of Artificial Sequence: Synthetic peptide
RVSTVQQLTK

SEQ ID NO: 2486 - protein, 10 aa, Artificial Sequence
  Description of Artificial Sequence: Synthetic peptide
RIEPSWADVK

SEQ ID NO: 2487 - protein, 10 aa, Artificial Sequence
  Description of Artificial Sequence: Synthetic peptide
RVIDPRRCMK

SEQ ID NO: 2488 - protein, 9 aa, Artificial Sequence
  Description of Artificial Sequence: Synthetic peptide
KITAEWLWK

SEQ ID NO: 2489 - protein, 9 aa, Artificial Sequence
  Description of Artificial Sequence: Synthetic peptide
RLRAEAQVK

SEQ ID NO: 2490 - protein, 9 aa, Artificial Sequence
  Description of Artificial Sequence: Synthetic peptide
RVRAYTYSK

SEQ ID NO: 2491 - protein, 9 aa, Artificial Sequence
  Description of Artificial Sequence: Synthetic peptide
RVCEKMALY

SEQ ID NO: 2492 - protein, 10 aa, Artificial Sequence
  Description of Artificial Sequence: Synthetic peptide
QVPLRPMTYK

SEQ ID NO: 2493 - protein, 9 aa, Artificial Sequence
  Description of Artificial Sequence: Synthetic peptide
RLRPGGKKK

SEQ ID NO: 2494 - protein, 9 aa, Artificial Sequence
  Description of Artificial Sequence: Synthetic peptide
AIFQSSMTK

SEQ ID NO: 2495 - protein, 9 aa, Artificial Sequence
  Description of Artificial Sequence: Synthetic peptide
KLCLRFLSK

SEQ ID NO: 2496 - protein, 9 aa, Artificial Sequence
  Description of Artificial Sequence: Synthetic peptide
ILRGSVAHK

SEQ ID NO: 2497 - protein, 10 aa, Artificial Sequence
  Description of Artificial Sequence: Synthetic peptide
GTSGSPIINR

SEQ ID NO: 2498 - protein, 10 aa, Artificial Sequence
  Description of Artificial Sequence: Synthetic peptide
GTSGSPIIDK

SEQ ID NO: 2499 - protein, 10 aa, Artificial Sequence
  Description of Artificial Sequence: Synthetic peptide
GTSGSPIVNR

SEQ ID NO: 2500 - protein, 10 aa, Artificial Sequence
  Description of Artificial Sequence: Synthetic peptide
GTSGSPIVDR

SEQ ID NO: 2501 - protein, 10 aa, Artificial Sequence
  Description of Artificial Sequence: Synthetic peptide
GTSGSPIADK

SEQ ID NO: 2502 - protein, 9 aa, Artificial Sequence
  Description of Artificial Sequence: Synthetic peptide
IVTDFSVIK

SEQ ID NO: 2503 - protein, 10 aa, Artificial Sequence
  Description of Artificial Sequence: Synthetic peptide
SSCSSCPLSK

SEQ ID NO: 2504 - protein, 9 aa, Artificial Sequence
  Description of Artificial Sequence: Synthetic peptide
ATIGTAMYK

SEQ ID NO: 2505 - protein, 10 aa, Artificial Sequence
  Description of Artificial Sequence: Synthetic peptide
AVFDRKSDAK

SEQ ID NO: 2506 - protein, 9 aa, Artificial Sequence
  Description of Artificial Sequence: Synthetic peptide
YVNVNMGLK

SEQ ID NO: 2507 - protein, 9 aa, Artificial Sequence
  Description of Artificial Sequence: Synthetic peptide
YVNTNMGLK

SEQ ID NO: 2508 - protein, 11 aa, Artificial Sequence
  Description of Artificial Sequence: Synthetic peptide
STLPETTVVRR

SEQ ID NO: 2509 - protein, 9 aa, Artificial Sequence
  Description of Artificial Sequence: Synthetic peptide
AVDLSHFLK

SEQ ID NO: 2510 - protein, 11 aa, Artificial Sequence
  Description of Artificial Sequence: Synthetic peptide
ACQGVGGPGHK

SEQ ID NO: 2511 - protein, 9 aa, Artificial Sequence
  Description of Artificial Sequence: Synthetic peptide
NTLEQTVKK

SEQ ID NO: 2512 - protein, 9 aa, Artificial Sequence
  Description of Artificial Sequence: Synthetic peptide
SIIPSGPLK

SEQ ID NO: 2513 - protein, 10 aa, Artificial Sequence
  Description of Artificial Sequence: Synthetic peptide
RMVLASTTAK

SEQ ID NO: 2514 - protein, 9 aa, Artificial Sequence
  Description of Artificial Sequence: Synthetic peptide
KSMREEYRK

SEQ ID NO: 2515 - protein, 9 aa, Artificial Sequence
  Description of Artificial Sequence: Synthetic peptide
TYFSLNNKF

SEQ ID NO: 2516 - protein, 9 aa, Artificial Sequence
  Description of Artificial Sequence: Synthetic peptide
TYACFVSNL

SEQ ID NO: 2517 - protein, 9 aa, Artificial Sequence
  Description of Artificial Sequence: Synthetic peptide
AFLPWHRLF

SEQ ID NO: 2518 - protein, 9 aa, Artificial Sequence
  Description of Artificial Sequence: Synthetic peptide
IMPKAGLLI

SEQ ID NO: 2519 - protein, 9 aa, Artificial Sequence
  Description of Artificial Sequence: Synthetic peptide
VYFFLPDHL

SEQ ID NO: 2520 - protein, 9 aa, Artificial Sequence
  Description of Artificial Sequence: Synthetic peptide
EYLQLVFGI

SEQ ID NO: 2521 - protein, 9 aa, Artificial Sequence
  Description of Artificial Sequence: Synthetic peptide
TYLPTNASL

SEQ ID NO: 2522 - protein, 9 aa, Artificial Sequence
  Description of Artificial Sequence: Synthetic peptide
VYGFVRACL

SEQ ID NO: 2523 - protein, 9 aa, Artificial Sequence
  Description of Artificial Sequence: Synthetic peptide
TFPDLESEF

SEQ ID NO: 2524 - protein, 9 aa, Artificial Sequence
  Description of Artificial Sequence: Synthetic peptide
DYLQYVLQI

SEQ ID NO: 2525 - protein, 10 aa, Artificial Sequence
  Description of Artificial Sequence: Synthetic peptide
RYCNLEGPPI

SEQ ID NO: 2526 - protein, 9 aa, Artificial Sequence
  Description of Artificial Sequence: Synthetic peptide
AYACNTSTL

SEQ ID NO: 2527 - protein, 9 aa, Artificial Sequence
  Description of Artificial Sequence: Synthetic peptide
CYASGWGSI

SEQ ID NO: 2528 - protein, 10 aa, Artificial Sequence
  Description of Artificial Sequence: Synthetic peptide
DYLNEWGSRF

SEQ ID NO: 2529 - protein, 9 aa, Artificial Sequence
  Description of Artificial Sequence: Synthetic peptide
EYCPGGNLF

SEQ ID NO: 2530 - protein, 9 aa, Artificial Sequence
  Description of Artificial Sequence: Synthetic peptide
EYYELFVNI

SEQ ID NO: 2531 - protein, 9 aa, Artificial Sequence
  Description of Artificial Sequence: Synthetic peptide
GYCTQIGIF

SEQ ID NO: 2532 - protein, 9 aa, Artificial Sequence
  Description of Artificial Sequence: Synthetic peptide
IYTWIEDHF

SEQ ID NO: 2533 - protein, 9 aa, Artificial Sequence
  Description of Artificial Sequence: Synthetic peptide
NYQPVWLCL

SEQ ID NO: 2534 - protein, 10 aa, Artificial Sequence
  Description of Artificial Sequence: Synthetic peptide
RYNAQCQETI

SEQ ID NO: 2535 - protein, 9 aa, Artificial Sequence
  Description of Artificial Sequence: Synthetic peptide
EYRALQLHL

SEQ ID NO: 2536 - protein, 9 aa, Artificial Sequence
  Description of Artificial Sequence: Synthetic peptide
SYRNEIAYL

SEQ ID NO: 2537 - protein, 9 aa, Artificial Sequence
  Description of Artificial Sequence: Synthetic peptide
VYLRVRPLL

SEQ ID NO: 2538 - protein, 9 aa, Artificial Sequence
  Description of Artificial Sequence: Synthetic peptide
VYYNWQYLL

SEQ ID NO: 2539 - protein, 9 aa, Artificial Sequence
  Description of Artificial Sequence: Synthetic peptide
VYALPLKML

SEQ ID NO: 2540 - protein, 9 aa, Artificial Sequence
  Description of Artificial Sequence: Synthetic peptide
QYDPVAALF

SEQ ID NO: 2541 - protein, 9 aa, Artificial Sequence
  Description of Artificial Sequence: Synthetic peptide
AYAQKIFKI

SEQ ID NO: 2542 - protein, 9 aa, Artificial Sequence
  Description of Artificial Sequence: Synthetic peptide
QYSDRRWCF

SEQ ID NO: 2543 - protein, 9 aa, Artificial Sequence
  Description of Artificial Sequence: Synthetic peptide
TYGPVFMCL

SEQ ID NO: 2544 - protein, 9 aa, Artificial Sequence
  Description of Artificial Sequence: Synthetic peptide
PYLFWLAAI

SEQ ID NO: 2545 - protein, 9 aa, Artificial Sequence
  Description of Artificial Sequence: Synthetic peptide
TYGPVFMSL

SEQ ID NO: 2546 - protein, 9 aa, Artificial Sequence
  Description of Artificial Sequence: Synthetic peptide
EYLVSFGVW

SEQ ID NO: 2547 - protein, 9 aa, Artificial Sequence
  Description of Artificial Sequence: Synthetic peptide
KYTSFPWLL

SEQ ID NO: 2548 - protein, 9 aa, Artificial Sequence
  Description of Artificial Sequence: Synthetic peptide
FFPSIRDLL

SEQ ID NO: 2549 - protein, 9 aa, Artificial Sequence
  Description of Artificial Sequence: Synthetic peptide
AYSQQTRGL

SEQ ID NO: 2550 - protein, 10 aa, Artificial Sequence
  Description of Artificial Sequence: Synthetic peptide
RYPLTFGWCY

SEQ ID NO: 2551 - protein, 9 aa, Artificial Sequence
  Description of Artificial Sequence: Synthetic peptide
RYLKDQQLL

SEQ ID NO: 2552 - protein, 9 aa, Artificial Sequence
  Description of Artificial Sequence: Synthetic peptide
RYLRDQQLL

SEQ ID NO: 2553 - protein, 10 aa, Artificial Sequence
  Description of Artificial Sequence: Synthetic peptide
RYPLTFGWCF

SEQ ID NO: 2554 - protein, 8 aa, Artificial Sequence
  Description of Artificial Sequence: Synthetic peptide
RYPLTFGW

SEQ ID NO: 2555 - protein, 9 aa, Artificial Sequence
  Description of Artificial Sequence: Synthetic peptide
VYDFAFRDL

SEQ ID NO: 2556 - protein, 9 aa, Artificial Sequence
  Description of Artificial Sequence: Synthetic peptide
SFHSLHLLF

SEQ ID NO: 2557 - protein, 10 aa, Artificial Sequence
  Description of Artificial Sequence: Synthetic peptide
KEKYIDQEEL

SEQ ID NO: 2558 - protein, 9 aa, Artificial Sequence
  Description of Artificial Sequence: Synthetic peptide
LYNTVATLY

SEQ ID NO: 2559 - protein, 9 aa, Artificial Sequence
  Description of Artificial Sequence: Synthetic peptide
SFDPIPIHY

SEQ ID NO: 2560 - protein, 10 aa, Artificial Sequence
  Description of Artificial Sequence: Synthetic peptide
SFNCRGEFFY

SEQ ID NO: 2561 - protein, 10 aa, Artificial Sequence
  Description of Artificial Sequence: Synthetic peptide
TVSGNILTIR

SEQ ID NO: 2562 - protein, 9 aa, Artificial Sequence
  Description of Artificial Sequence: Synthetic peptide
VPQYGYLTL

SEQ ID NO: 2563 - protein, 11 aa, Artificial Sequence
  Description of Artificial Sequence: Synthetic peptide
KPYSGTAYNSL

SEQ ID NO: 2564 - protein, 11 aa, Artificial Sequence
  Description of Artificial Sequence: Synthetic peptide
KPYSGTAYNAL

SEQ ID NO: 2565 - protein, 9 aa, Artificial Sequence
  Description of Artificial Sequence: Synthetic peptide
LPLMRKAYL

SEQ ID NO: 2566 - protein, 9 aa, Artificial Sequence
  Description of Artificial Sequence: Synthetic peptide
LPWHRLFLL

SEQ ID NO: 2567 - protein, 9 aa, Artificial Sequence
  Description of Artificial Sequence: Synthetic peptide
  MOD_RES (4)..(4): Phospho-Ser
EPRSPSHSM

SEQ ID NO: 2568 - protein, 9 aa, Artificial Sequence
  Description of Artificial Sequence: Synthetic peptide
TPNQRQNVC

SEQ ID NO: 2569 - protein, 9 aa, Artificial Sequence
  Description of Artificial Sequence: Synthetic peptide
APRGVRMAV

SEQ ID NO: 2570 - protein, 9 aa, Artificial Sequence
  Description of Artificial Sequence: Synthetic peptide
LPVSPRLQL

SEQ ID NO: 2571 - protein, 10 aa, Artificial Sequence
  Description of Artificial Sequence: Synthetic peptide
TPRVTGGGAM

SEQ ID NO: 2572 - protein, 11 aa, Artificial Sequence
  Description of Artificial Sequence: Synthetic peptide
RPHERNGFTVL

SEQ ID NO: 2573 - protein, 9 aa, Artificial Sequence
  Description of Artificial Sequence: Synthetic peptide
SPRWYFYYL

SEQ ID NO: 2574 - protein, 10 aa, Artificial Sequence
  Description of Artificial Sequence: Synthetic peptide
APTRVVAAEM

SEQ ID NO: 2575 - protein, 9 aa, Artificial Sequence
  Description of Artificial Sequence: Synthetic peptide
RPPIFIRRL

SEQ ID NO: 2576 - protein, 13 aa, Artificial Sequence
  Description of Artificial Sequence: Synthetic peptide
RPQGGSRPEFVKL

SEQ ID NO: 2577 - protein, 9 aa, Artificial Sequence
  Description of Artificial Sequence: Synthetic peptide
QPRAPIRPI

SEQ ID NO: 2578 - protein, 9 aa, Artificial Sequence
  Description of Artificial Sequence: Synthetic peptide
LPSDFFPSV

SEQ ID NO: 2579 - protein, 9 aa, Artificial Sequence
  Description of Artificial Sequence: Synthetic peptide
GPRLGVRAT

SEQ ID NO: 2580 - protein, 9 aa, Artificial Sequence
  Description of Artificial Sequence: Synthetic peptide
DPRRRSRNL

SEQ ID NO: 2581 - protein, 9 aa, Artificial Sequence
  Description of Artificial Sequence: Synthetic peptide
IPRRIRQGL

SEQ ID NO: 2582 - protein, 10 aa, Artificial Sequence
  Description of Artificial Sequence: Synthetic peptide
TPGPGVRYPL

SEQ ID NO: 2583 - protein, 9 aa, Artificial Sequence
  Description of Artificial Sequence: Synthetic peptide
GPGHKARVL

SEQ ID NO: 2584 - protein, 9 aa, Artificial Sequence
  Description of Artificial Sequence: Synthetic peptide
KPTLKEYVL

SEQ ID NO: 2585 - protein, 9 aa, Artificial Sequence
  Description of Artificial Sequence: Synthetic peptide
LPVSCPEDL

SEQ ID NO: 2586 - protein, 9 aa, Artificial Sequence
  Description of Artificial Sequence: Synthetic peptide
QPEWFRNVL

SEQ ID NO: 2587 - protein, 9 aa, Artificial Sequence
  Description of Artificial Sequence: Synthetic peptide
SPIVPSFDM

SEQ ID NO: 2588 - protein, 11 aa, Artificial Sequence
  Description of Artificial Sequence: Synthetic peptide
SPSVDKARAEL

SEQ ID NO: 2589 - protein, 9 aa, Artificial Sequence
  Description of Artificial Sequence: Synthetic peptide
GFKQSSKAL

SEQ ID NO: 2590 - protein, 9 aa, Artificial Sequence
  Description of Artificial Sequence: Synthetic peptide
ELRRKMMYM

SEQ ID NO: 2591 - protein, 9 aa, Artificial Sequence
  Description of Artificial Sequence: Synthetic peptide
ELKRKMIYM

SEQ ID NO: 2592 - protein, 8 aa, Artificial Sequence
  Description of Artificial Sequence: Synthetic peptide
RIKQKGIL

SEQ ID NO: 2593 - protein, 8 aa, Artificial Sequence
  Description of Artificial Sequence: Synthetic peptide
LEKTKKDL

SEQ ID NO: 2594 - protein, 9 aa, Artificial Sequence
  Description of Artificial Sequence: Synthetic peptide
FLRGRAYGL

SEQ ID NO: 2595 - protein, 8 aa, Artificial Sequence
  Description of Artificial Sequence: Synthetic peptide
RAKFKQLL

SEQ ID NO: 2596 - protein, 9 aa, Artificial Sequence
  Description of Artificial Sequence: Synthetic peptide
QAKWRLQTL

SEQ ID NO: 2597 - protein, 8 aa, Artificial Sequence
  Description of Artificial Sequence: Synthetic peptide
GLKILQLL

SEQ ID NO: 2598 - protein, 9 aa, Artificial Sequence
  Description of Artificial Sequence: Synthetic peptide
HSKKKCDEL

SEQ ID NO: 2599 - protein, 8 aa, Artificial Sequence
  Description of Artificial Sequence: Synthetic peptide
FLKEKGGL

SEQ ID NO: 2600 - protein, 9 aa, Artificial Sequence
  Description of Artificial Sequence: Synthetic peptide
GEIYKRWII

SEQ ID NO: 2601 - protein, 8 aa, Artificial Sequence
  Description of Artificial Sequence: Synthetic peptide
EIYKRWII

SEQ ID NO: 2602 - protein, 8 aa, Artificial Sequence
  Description of Artificial Sequence: Synthetic peptide
YLKDQQLL

SEQ ID NO: 2603 - protein, 9 aa, Artificial Sequence
  Description of Artificial Sequence: Synthetic peptide
CLIPTAMAF

SEQ ID NO: 2604 - protein, 10 aa, Artificial Sequence
  Description of Artificial Sequence: Synthetic peptide
RLRPGGKKKY

SEQ ID NO: 2605 - protein, 9 aa, Artificial Sequence
  Description of Artificial Sequence: Synthetic peptide
GRFGLATEK

SEQ ID NO: 2606 - protein, 9 aa, Artificial Sequence
  Description of Artificial Sequence: Synthetic peptide
GRFGLATVK

SEQ ID NO: 2607 - protein, 9 aa, Artificial Sequence
  Description of Artificial Sequence: Synthetic peptide
ARKLLLDNL

SEQ ID NO: 2608 - protein, 9 aa, Artificial Sequence
  Description of Artificial Sequence: Synthetic peptide
NRAKQVIKL

SEQ ID NO: 2609 - protein, 9 aa, Artificial Sequence
  Description of Artificial Sequence: Synthetic peptide
QRNAPRITF

SEQ ID NO: 2610 - protein, 9 aa, Artificial Sequence
  Description of Artificial Sequence: Synthetic peptide
ARMILMTHF

SEQ ID NO: 2611 - protein, 10 aa, Artificial Sequence
  Description of Artificial Sequence: Synthetic peptide
KRWIILGLNK

SEQ ID NO: 2612 - protein, 10 aa, Artificial Sequence
  Description of Artificial Sequence: Synthetic peptide
KRWIIMGLNK

SEQ ID NO: 2613 - protein, 9 aa, Artificial Sequence
  Description of Artificial Sequence: Synthetic peptide
GRAFVTIGK

SEQ ID NO: 2614 - protein, 9 aa, Artificial Sequence
  Description of Artificial Sequence: Synthetic peptide
SRYWAIRTR

SEQ ID NO: 2615 - protein, 9 aa, Artificial Sequence
  Description of Artificial Sequence: Synthetic peptide
IPYLDGTFY

SEQ ID NO: 2616 - protein, 9 aa, Artificial Sequence
  Description of Artificial Sequence: Synthetic peptide
MPFATPMEA

SEQ ID NO: 2617 - protein, 9 aa, Artificial Sequence
  Description of Artificial Sequence: Synthetic peptide
IPSINVHHY

SEQ ID NO: 2618 - protein, 9 aa, Artificial Sequence
  Description of Artificial Sequence: Synthetic peptide
TPEGIIPTL

SEQ ID NO: 2619 - protein, 9 aa, Artificial Sequence
  Description of Artificial Sequence: Synthetic peptide
YPLHEQHGM

SEQ ID NO: 2620 - protein, 11 aa, Artificial Sequence
  Description of Artificial Sequence: Synthetic peptide
EPLPQGQLTAY

SEQ ID NO: 2621 - protein, 11 aa, Artificial Sequence
  Description of Artificial Sequence: Synthetic peptide
HPVAEADYFEY

SEQ ID NO: 2622 - protein, 9 aa, Artificial Sequence
  Description of Artificial Sequence: Synthetic peptide
HPNIEEVAL

SEQ ID NO: 2623 - protein, 8 aa, Artificial Sequence
  Description of Artificial Sequence: Synthetic peptide
CPNSSIVY

SEQ ID NO: 2624 - protein, 9 aa, Artificial Sequence
  Description of Artificial Sequence: Synthetic peptide
NPDIVIYQY

SEQ ID NO: 2625 - protein, 9 aa, Artificial Sequence
  Description of Artificial Sequence: Synthetic peptide
NPDIVIYQY

SEQ ID NO: 2626 - protein, 10 aa, Artificial Sequence
  Description of Artificial Sequence: Synthetic peptide
VPLDEDFRKY

SEQ ID NO: 2627 - protein, 10 aa, Artificial Sequence
  Description of Artificial Sequence: Synthetic peptide
MEVTPSGTWL

SEQ ID NO: 2628 - protein, 10 aa, Artificial Sequence
  Description of Artificial Sequence: Synthetic peptide
GEARKTFVEL

SEQ ID NO: 2629 - protein, 9 aa, Artificial Sequence
  Description of Artificial Sequence: Synthetic peptide
IEDPPFNSL

SEQ ID NO: 2630 - protein, 10 aa, Artificial Sequence
  Description of Artificial Sequence: Synthetic peptide
REISVPAEIL

SEQ ID NO: 2631 - protein, 9 aa, Artificial Sequence
  Description of Artificial Sequence: Synthetic peptide
KEKGGLEGL

SEQ ID NO: 2632 - protein, 9 aa, Artificial Sequence
  Description of Artificial Sequence: Synthetic peptide
TRATKMQVI

SEQ ID NO: 2633 - protein, 8 aa, Artificial Sequence
  Description of Artificial Sequence: Synthetic peptide
QIKVRVDM

SEQ ID NO: 2634 - protein, 9 aa, Artificial Sequence
  Description of Artificial Sequence: Synthetic peptide
TRRFLPQIL

SEQ ID NO: 2635 - protein, 9 aa, Artificial Sequence
  Description of Artificial Sequence: Synthetic peptide
CRVLCCYVL

SEQ ID NO: 2636 - protein, 9 aa, Artificial Sequence
  Description of Artificial Sequence: Synthetic peptide
VMAPRTLIL

SEQ ID NO: 2637 - protein, 9 aa, Artificial Sequence
  Description of Artificial Sequence: Synthetic peptide
VMAPRTLVL

SEQ ID NO: 2638 - protein, 10 aa, Artificial Sequence
  Description of Artificial Sequence: Synthetic peptide
TTDPSFLGRY

SEQ ID NO: 2639 - protein, 9 aa, Artificial Sequence
  Description of Artificial Sequence: Synthetic peptide
PTDNYITTY

SEQ ID NO: 2640 - protein, 9 aa, Artificial Sequence
  Description of Artificial Sequence: Synthetic peptide
KLQVFLIVL

SEQ ID NO: 2641 - protein, 16 aa, Artificial Sequence
  Description of Artificial Sequence: Synthetic peptide
DSVTPMILKAQKGGNL

SEQ ID NO: 2642 - protein, 12 aa, Artificial Sequence
  Description of Artificial Sequence: Synthetic peptide
KCIEWEKAQHGA

SEQ ID NO: 2643 - protein, 18 aa, Artificial Sequence
  Description of Artificial Sequence: Synthetic peptide
LPVVLENARILKNCVDAK

SEQ ID NO: 2644 - protein, 15 aa, Artificial Sequence
  Description of Artificial Sequence: Synthetic peptide
LRQMRTVTPIRMQGG

SEQ ID NO: 2645 - protein, 20 aa, Artificial Sequence
  Description of Artificial Sequence: Synthetic peptide
VAAAPQVKYAVFEAALTKAI

SEQ ID NO: 2646 - protein, 15 aa, Artificial Sequence
  Description of Artificial Sequence: Synthetic peptide
YESYKFIPALEAAVK

SEQ ID NO: 2647 - protein, 15 aa, Artificial Sequence
  Description of Artificial Sequence: Synthetic peptide
ETLLRAVESYLLAHS

SEQ ID NO: 2648 - protein, 16 aa, Artificial Sequence
  Description of Artificial Sequence: Synthetic peptide
ACYEFLWGPRALVETS

SEQ ID NO: 2649 - protein, 15 aa, Artificial Sequence
  Description of Artificial Sequence: Synthetic peptide
LKEFTVSGNILTIRL

SEQ ID NO: 2650 - protein, 15 aa, Artificial Sequence
  Description of Artificial Sequence: Synthetic peptide
LLEFYLAMPFATPME

SEQ ID NO: 2651 - protein, 17 aa, Artificial Sequence
  Description of Artificial Sequence: Synthetic peptide
KVPIKWMALESILRRRF

SEQ ID NO: 2652 - protein, 14 aa, Artificial Sequence
  Description of Artificial Sequence: Synthetic peptide
LPLKMLNIPSINVH

SEQ ID NO: 2653 - protein, 16 aa, Artificial Sequence
  Description of Artificial Sequence: Synthetic peptide
GAALQIPFAMQMAYRF

SEQ ID NO: 2654 - protein, 16 aa, Artificial Sequence
  Description of Artificial Sequence: Synthetic peptide
MAYRFNGIGVTQNVLY

SEQ ID NO: 2655 - protein, 18 aa, Artificial Sequence
  Description of Artificial Sequence: Synthetic peptide
QLIRAAEIRASANLAATK

SEQ ID NO: 2656 - protein, 11 aa, Artificial Sequence
  Description of Artificial Sequence: Synthetic peptide
TVFYNIPPMPL

SEQ ID NO: 2657 - protein, 13 aa, Artificial Sequence
  Description of Artificial Sequence: Synthetic peptide
TSLYNLRRGTALA

SEQ ID NO: 2658 - protein, 16 aa, Artificial Sequence
  Description of Artificial Sequence: Synthetic peptide
QAGFFLLTRILTIPQS

SEQ ID NO: 2659 - protein, 15 aa, Artificial Sequence
  Description of Artificial Sequence: Synthetic peptide
PPAYRPPNAPILSTL

SEQ ID NO: 2660 - protein, 16 aa, Artificial Sequence
  Description of Artificial Sequence: Synthetic peptide
LCWGELMTLATWVGVN

SEQ ID NO: 2661 - protein, 13 aa, Artificial Sequence
  Description of Artificial Sequence: Synthetic peptide
TLLFNILGGWVAA

SEQ ID NO: 2662 - protein, 13 aa, Artificial Sequence
  Description of Artificial Sequence: Synthetic peptide
DYVDRFYKTLRAE

SEQ ID NO: 2663 - protein, 20 aa, Artificial Sequence
  Description of Artificial Sequence: Synthetic peptide
KRWIILGLNKIVRMYSPTSI

SEQ ID NO: 2664 - protein, 20 aa, Artificial Sequence
  Description of Artificial Sequence: Synthetic peptide
FRDYVDRFYKTLRAEQASQE

SEQ ID NO: 2665 - protein, 15 aa, Artificial Sequence
  Description of Artificial Sequence: Synthetic peptide
SGPLKAEIAQRLEDV

SEQ ID NO: 2666 - protein, 13 aa, Artificial Sequence
  Description of Artificial Sequence: Synthetic peptide
PKYVKQNTLKLAT

SEQ ID NO: 2667 - protein, 20 aa, Artificial Sequence
  Description of Artificial Sequence: Synthetic peptide
EYLNKIQNSLSTEWSPCSVT

SEQ ID NO: 2668 - protein, 15 aa, Artificial Sequence
  Description of Artificial Sequence: Synthetic peptide
PVSKMRMATPLLMQA

SEQ ID NO: 2669 - protein, 13 aa, Artificial Sequence
  Description of Artificial Sequence: Synthetic peptide
QEIYMQHTYPISA

SEQ ID NO: 2670 - protein, 15 aa, Artificial Sequence
  Description of Artificial Sequence: Synthetic peptide
GEEYLILSARDVLAV

SEQ ID NO: 2671 - protein, 15 aa, Artificial Sequence
  Description of Artificial Sequence: Synthetic peptide
HTYTIDWTKDAVTWS

SEQ ID NO: 2672 - protein, 16 aa, Artificial Sequence
  Description of Artificial Sequence: Synthetic peptide
VYYLTRDPTTPLARAA

SEQ ID NO: 2673 - protein, 16 aa, Artificial Sequence
  Description of Artificial Sequence: Synthetic peptide
PIVQLQGDSNCLKCFR

SEQ ID NO: 2674 - protein, 20 aa, Artificial Sequence
  Description of Artificial Sequence: Synthetic peptide
MEAIAKRLDACQDQLLELYE

SEQ ID NO: 2675 - protein, 12 aa, Artificial Sequence
  Description of Artificial Sequence: Synthetic peptide
RQIFGDYKTTIC

SEQ ID NO: 2676 - protein, 13 aa, Artificial Sequence
  Description of Artificial Sequence: Synthetic peptide
MAKTIAYDEEARR

SEQ ID NO: 2677 - protein, 11 aa, Artificial Sequence
  Description of Artificial Sequence: Synthetic peptide
KTIAYDEEARR

SEQ ID NO: 2678 - protein, 13 aa, Artificial Sequence
  Description of Artificial Sequence: Synthetic peptide
APYHFDLSGHAFG

SEQ ID NO: 2679 - protein, 16 aa, Artificial Sequence
  Description of Artificial Sequence: Synthetic peptide
ELEKYQQLNSERGVPN

SEQ ID NO: 2680 - protein, 15 aa, Artificial Sequence
  Description of Artificial Sequence: Synthetic peptide
ETLLRAVESYLLAHS

SEQ ID NO: 2681 - protein, 15 aa, Artificial Sequence
  Description of Artificial Sequence: Synthetic peptide
FHTYTIDWTKDAVTW

SEQ ID NO: 2682 - protein, 13 aa, Artificial Sequence
  Description of Artificial Sequence: Synthetic peptide
NFIRMVISNPAAT

SEQ ID NO: 2683 - protein, 13 aa, Artificial Sequence
  Description of Artificial Sequence: Synthetic peptide
IAFTSEHSHFSLK

SEQ ID NO: 2684 - protein, 18 aa, Artificial Sequence
  Description of Artificial Sequence: Synthetic peptide
GAGSLQPLALEGSLQKRG

SEQ ID NO: 2685 - protein, 15 aa, Artificial Sequence
  Description of Artificial Sequence: Synthetic peptide
GIVEQCCTSICSLYQ

SEQ ID NO: 2686 - protein, 13 aa, Artificial Sequence
  Description of Artificial Sequence: Synthetic peptide
  MOD_RES (4)..(4): Gly[cit]
  MOD_RES (5)..(5): Val[cit]
ATEGVVNSAYQDK

SEQ ID NO: 2687 - protein, 14 aa, Artificial Sequence
  Description of Artificial Sequence: Synthetic peptide
  MOD_RES (8)..(8): Val[cit]
ATIKAEFVAETPYM

SEQ ID NO: 2688 - protein, 13 aa, Artificial Sequence
  Description of Artificial Sequence: Synthetic peptide
  MOD_RES (6)..(6): Ile[cit]
  MOD_RES (8)..(8): Val[cit]
GKLYGIDVSTRDR

SEQ ID NO: 2689 - protein, 17 aa, Artificial Sequence
  Description of Artificial Sequence: Synthetic peptide
  MOD_RES (5)..(5): Thr[cit]
  MOD_RES (9)..(9): Val[cit]
  MOD_RES (10)..(10): Leu[cit]
GVYATSSAVLSSVPGVR

SEQ ID NO: 2690 - protein, 14 aa, Artificial Sequence
  Description of Artificial Sequence: Synthetic peptide
  MOD_RES (4)..(4): Ser[cit]
IFDSGNPTVEVDLF

SEQ ID NO: 2691 - protein, 20 aa, Artificial Sequence
  Description of Artificial Sequence: Synthetic peptide
KGMAALPRLIAFTSEHSHFS

SEQ ID NO: 2692 - protein, 12 aa, Artificial Sequence
  Description of Artificial Sequence: Synthetic peptide
  MOD_RES (5)..(5): Asn[cit]
QDFTNINKLKNS

SEQ ID NO: 2693 - protein, 16 aa, Artificial Sequence
  Description of Artificial Sequence: Synthetic peptide
WNRQLYPEWTEAQRLD

SEQ ID NO: 2694 - protein, 21 aa, Artificial Sequence
  Description of Artificial Sequence: Synthetic peptide
ISPNSVFSQWRVVCDSLEDYD

SEQ ID NO: 2695 - protein, 15 aa, Artificial Sequence
  Description of Artificial Sequence: Synthetic peptide
ESEFQAALSRKVAKL

SEQ ID NO: 2696 - protein, 18 aa, Artificial Sequence
  Description of Artificial Sequence: Synthetic peptide
LTQYFVQENYLEYRQVPG

SEQ ID NO: 2697 - protein, 15 aa, Artificial Sequence
  Description of Artificial Sequence: Synthetic peptide
YACFVSNLATGRNNS

SEQ ID NO: 2698 - protein, 15 aa, Artificial Sequence
  Description of Artificial Sequence: Synthetic peptide
NYTLRVDCTPLMYSL

SEQ ID NO: 2699 - protein, 19 aa, Artificial Sequence
  Description of Artificial Sequence: Synthetic peptide
IYRRRLMKQDFSVPQLPHS

SEQ ID NO: 2700 - protein, 17 aa, Artificial Sequence
  Description of Artificial Sequence: Synthetic peptide
ALHIYMDGTMSQVQGSA

SEQ ID NO: 2701 - protein, 23 aa, Artificial Sequence
  Description of Artificial Sequence: Synthetic peptide
RNGYRALMDKSLHVGTQCALTRR

SEQ ID NO: 2702 - protein, 17 aa, Artificial Sequence
  Description of Artificial Sequence: Synthetic peptide
QALNTLVKQLSSNFGAI

SEQ ID NO: 2703 - protein, 12 aa, Artificial Sequence
  Description of Artificial Sequence: Synthetic peptide
PYYVVDLSVRGM

SEQ ID NO: 2704 - protein, 15 aa, Artificial Sequence
  Description of Artificial Sequence: Synthetic peptide
AEGLRALLARSHVER

SEQ ID NO: 2705 - protein, 20 aa, Artificial Sequence
  Description of Artificial Sequence: Synthetic peptide
GQTYHLIVDTDSLGNPSLSV

SEQ ID NO: 2706 - protein, 15 aa, Artificial Sequence
  Description of Artificial Sequence: Synthetic peptide
LSFLPSDFFPSVRDL

SEQ ID NO: 2707 - protein, 15 aa, Artificial Sequence
  Description of Artificial Sequence: Synthetic peptide
GYKVLVLNPSVAATL

SEQ ID NO: 2708 - protein, 21 aa, Artificial Sequence
  Description of Artificial Sequence: Synthetic peptide
SGIQYLAGLSTLPGNPAIASL

SEQ ID NO: 2709 - protein, 20 aa, Artificial Sequence
  Description of Artificial Sequence: Synthetic peptide
AFSPEVIPMFSALSEGATPQ

SEQ ID NO: 2710 - protein, 24 aa, Artificial Sequence
  Description of Artificial Sequence: Synthetic peptide
FWRGENGRKTRIAYERMCNILKGK

SEQ ID NO: 2711 - protein, 12 aa, Artificial Sequence
  Description of Artificial Sequence: Synthetic peptide
GFVFTLTVPSER

SEQ ID NO: 2712 - protein, 13 aa, Artificial Sequence
  Description of Artificial Sequence: Synthetic peptide
RTELLKDAIGEGK

SEQ ID NO: 2713 - protein, 20 aa, Artificial Sequence
  Description of Artificial Sequence: Synthetic peptide
TWTTCQSIAFPSKTSASIGS

SEQ ID NO: 2714 - protein, 15 aa, Artificial Sequence
  Description of Artificial Sequence: Synthetic peptide
SSPKPWIYATSNLAS

SEQ ID NO: 2715 - protein, 13 aa, Artificial Sequence
  Description of Artificial Sequence: Synthetic peptide
LWWVNNQSLPVSP

SEQ ID NO: 2716 - protein, 13 aa, Artificial Sequence
  Description of Artificial Sequence: Synthetic peptide
DRVNFKYSFSVIE

SEQ ID NO: 2717 - protein, 13 aa, Artificial Sequence
  Description of Artificial Sequence: Synthetic peptide
VGLLKAVESYLLA

SEQ ID NO: 2718 - protein, 16 aa, Artificial Sequence
  Description of Artificial Sequence: Synthetic peptide
YYSNVTATRLLSSTNS

SEQ ID NO: 2719 - protein, 15 aa, Artificial Sequence
  Description of Artificial Sequence: Synthetic peptide
EPDVYYTSAFVFPTK

SEQ ID NO: 2720 - protein, 15 aa, Artificial Sequence
  Description of Artificial Sequence: Synthetic peptide
PDDYSNTHSTRYVTV

SEQ ID NO: 2721 - protein, 18 aa, Artificial Sequence
  Description of Artificial Sequence: Synthetic peptide
VPGLYSPCRAFFNKEELL

SEQ ID NO: 2722 - protein, 20 aa, Artificial Sequence
  Description of Artificial Sequence: Synthetic peptide
PGPLRESIVCYFMVFLQTHI

SEQ ID NO: 2723 - protein, 20 aa, Artificial Sequence
  Description of Artificial Sequence: Synthetic peptide
VYGGSKTSLYNLRRGTALAI

SEQ ID NO: 2724 - protein, 20 aa, Artificial Sequence
  Description of Artificial Sequence: Synthetic peptide
PRSPTVFYNIPPMPLPPSQL

SEQ ID NO: 2725 - protein, 21 aa, Artificial Sequence
  Description of Artificial Sequence: Synthetic peptide
AYCLWMMLLISQAEAALELIT

SEQ ID NO: 2726 - protein, 17 aa, Artificial Sequence
  Description of Artificial Sequence: Synthetic peptide
WPLLLLLLALPQRAYAQ

SEQ ID NO: 2727 - protein, 18 aa, Artificial Sequence
  Description of Artificial Sequence: Synthetic peptide
SLTITSLLRRHNWITSCS

SEQ ID NO: 2728 - protein, 17 aa, Artificial Sequence
  Description of Artificial Sequence: Synthetic peptide
TTVRLRAYMNTPGLPVC

SEQ ID NO: 2729 - protein, 15 aa, Artificial Sequence
  Description of Artificial Sequence: Synthetic peptide
WVKQTPGRGLEWIGA

SEQ ID NO: 2730 - protein, 15 aa, Artificial Sequence
  Description of Artificial Sequence: Synthetic peptide
EWVAEIRSKSINSAT

SEQ ID NO: 2731 - protein, 15 aa, Artificial Sequence
  Description of Artificial Sequence: Synthetic peptide
MTEQQWNFAGIEAAA

SEQ ID NO: 2732 - protein, 20 aa, Artificial Sequence
  Description of Artificial Sequence: Synthetic peptide
LEAAFNAEFNEIRRVLLEEN

SEQ ID NO: 2733 - protein, 20 aa, Artificial Sequence
  Description of Artificial Sequence: Synthetic peptide
TSRNNPFYFPSRRFSTRYGN

SEQ ID NO: 2734 - protein, 20 aa, Artificial Sequence
  Description of Artificial Sequence: Synthetic peptide
VVNKGTGNLELVAVRKEQQQ

SEQ ID NO: 2735 - protein, 15 aa, Artificial Sequence
  Description of Artificial Sequence: Synthetic peptide
TSYVKVLHHMVKISG

SEQ ID NO: 2736 - protein, 20 aa, Artificial Sequence
  Description of Artificial Sequence: Synthetic peptide
ENIQRFLPNPAGVQLEDPEF

SEQ ID NO: 2737 - protein, 16 aa, Artificial Sequence
  Description of Artificial Sequence: Synthetic peptide
VSIDKFRIFCKALNPK

SEQ ID NO: 2738 - protein, 21 aa, Artificial Sequence
  Description of Artificial Sequence: Synthetic peptide
FNNFTVSFWLRVPKVSASHLE

SEQ ID NO: 2739 - protein, 16 aa, Artificial Sequence
  Description of Artificial Sequence: Synthetic peptide
KFIIKRYTPNNEIDSF

SEQ ID NO: 2740 - protein, 15 aa, Artificial Sequence
  Description of Artificial Sequence: Synthetic peptide
QYIKANSKFIGITEL

SEQ ID NO: 2741 - protein, 15 aa, Artificial Sequence
  Description of Artificial Sequence: Synthetic peptide
AVNIVGYSNAQGVDY

SEQ ID NO: 2742 - protein, 15 aa, Artificial Sequence
  Description of Artificial Sequence: Synthetic peptide
MSIYVYALPLKMLNI

SEQ ID NO: 2743 - protein, 16 aa, Artificial Sequence
  Description of Artificial Sequence: Synthetic peptide
NFPYLVAYQATVCARA

SEQ ID NO: 2744 - protein, 15 aa, Artificial Sequence
  Description of Artificial Sequence: Synthetic peptide
GINAVAYYRGLDVSV

SEQ ID NO: 2745 - protein, 15 aa, Artificial Sequence
  Description of Artificial Sequence: Synthetic peptide
MHVSFVMAYPEMLAA

SEQ ID NO: 2746 - protein, 15 aa, Artificial Sequence
  Description of Artificial Sequence: Synthetic peptide
MSQIMYNYPAMMAHA

SEQ ID NO: 2747 - DNA, 2388 bp, Artificial Sequence
  Description of Artificial Sequence: Synthetic polynucleotide
gccgccaccatggccttaccagtgaccgccttgctcctgccgctggccttgctgctccacgccgccaggccggctgcacaagttcagctcgttgaatccggcggaaaccttgttcaaccggggggttccctccgccttagttgtgccgcatctggttttacgtttggatcattttccatgtcatgggtgcggcaggctcccggggggggactcgaatgggttgcgggtcttagcgcccgatcaagcctcactcactatgcagatagcgtaaaaggcaggtttacaatctcacgagacaacgcgaagaactcagtctatcttcagatgaactctctccgagtcgaggatacggctgtctattattgtgcacgccgctcctacgattcctcaggctacgccgggcacttttattcatacatggatgtctggggccagggaaccttggtaactgtgtctggaggaggtggatcagggggtggcggaagtggcggaggtggatcctccgtcttgacccagccctcctcagtcagtgctgcccctggccaaaaggttacaatatcatgttcaggtagtacgtcaaacataggcaacaactacgtgagttggtaccagcaacatcctggcaaagcacctaagttgatgatctatgatgtcagtaagcggccatctggggtacccgaccgattctcaggctcaaagagcggaaactccgcgtccctcgacataagtggcctccaatccgaggacgaggccgactactactgtgctgcttgggacgactctctctcagagtttttgtttgggaccggtacaaaactgactgttcttggggaacaaaaactcatctcagaagaagatctgaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 2748 - protein, 792 aa, Artificial Sequence
  Description of Artificial Sequence: Synthetic polypeptide
MALPVTALLLPLALLLHAARPAAQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYAGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGEQKLISEEDLNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 2749 - protein, 4 aa, Artificial Sequence
  Description of Artificial Sequence: Synthetic peptide
KDEL

SEQ ID NO: 2750 - protein, 8 aa, Artificial Sequence
  Description of Artificial Sequence: Synthetic peptide
SIINFEKL

SEQ ID NO: 2751 - protein, 9 aa, Artificial Sequence
  Description of Artificial Sequence: Synthetic peptide
AAHAEINEA

SEQ ID NO: 2752 - protein, 6 aa, Artificial Sequence
  Description of Artificial Sequence: Synthetic peptide
SIINFE

SEQ ID NO: 2753 - protein, 6 aa, Artificial Sequence
  Description of Artificial Sequence: Synthetic peptide
PVSKMI

SEQ ID NO: 2754 - protein, 6 aa, Artificial Sequence
  Description of Artificial Sequence: Synthetic peptide
PVSKMR

SEQ ID NO: 2755 - protein, 8 aa, Artificial Sequence
  Description of Artificial Sequence: Synthetic peptide
AAHAEINE

SEQ ID NO: 2756 - protein, 7 aa, Artificial Sequence
  Description of Artificial Sequence: Synthetic peptide
HAEINEA

SEQ ID NO: 2757 - protein, 10 aa, Artificial Sequence
  Description of Artificial Sequence: Synthetic peptide
HAAHAEINEA

What is claimed herein is:

1. A composition, comprising:
   a) a soluble extracellular molecule or a soluble extracellular complex comprising:
      a TCR recognition domain that binds specifically to a variable region of a TCR on target cells, and a first biomolecular interaction domain of a binding pair of biomolecular interaction domains; and
   b) an engineered cell expressing or comprising an engineered signaling polypeptide comprising:
      an extracellular second biomolecular interaction domain of the binding pair of biomolecular interaction domains, and an intracellular signaling domain,
   wherein the engineered cell is a T-cell or an NK cell or a dendritic cell, wherein the composition is characterized in that it exhibits cell killing activity against a population of the target cells expressing the variable region of the TCR.

2. The composition of claim 1, wherein the TCR recognition domain comprises a MHC (Major Histocompatibility Complex); a MI-IC-peptide complex; a featureless peptide MHC; or a MHC-peptide fusion.

3. The composition of claim 1, wherein the TCR recognition domain is a monomer, a dimer, a trimer, a tetramer, a pentamer, a dextramer, or an other oligomer form.

4. The composition of claim 1,
   a) wherein the binding pair of biomolecular interaction domains are collectively a pair of leucine zippers;
   b) wherein the binding pair of biomolecular interaction domains are collectively a BZip (RR) and a AZip (EE);
   c) wherein the binding pair of biomolecular interaction domains is a PSD95-Dlg1-zo-1 (PDZ) domain;
   d) wherein the binding pair of biomolecular interaction domains are collectively a streptavidin and a streptavidin binding protein (SBP);
   e) wherein the binding pair of biomolecular interaction domains are collectively a FKBP-binding domain of mTOR (FRB) and a FK506 binding protein (FKBP);
   f) wherein the binding pair of biomolecular interaction domains are collectively a cyclophilin-Fas fusion protein (CyP-Fas) and a FK506 binding protein (FKBP);
   g) wherein the binding pair of biomolecular interaction domains are collectively a calcineurin A (CNA) and a FK506 binding protein (FKBP);
   h) wherein the binding pair of biomolecular interaction domains are collectively a gibberellin insensitive (GIA) and a gibberellin insensitive dwarf1 (GID1);
   i) wherein the binding pair of biomolecular interaction domains are collectively a Snap-tag and a Halo tag;
   j) wherein the binding pair of biomolecular interaction domains are collectively a T14-3-3-cdeltaC and a C-Terminal peptides of PMA2 (CT52);
   k) wherein the binding pair of biomolecular interaction domains are collectively a PYL and a ABI;
   l) wherein the binding pair of biomolecular interaction domains are collectively a nucleotide tag and a zinc finger domain;
   m) wherein the binding pair of biomolecular interaction domains are collectively a pair of nucleotide tags;
   o) wherein the binding pair of protein interaction domains are collectively a FITC and a FITC binding protein; and/or
   p) wherein the binding pair of protein interaction domains are collectively a (R)-Phycoerythrin (R-PE/PE) and a R-PE/PE binding protein.

5. The composition of claim 1, wherein
   a) the binding pair of biomolecular interaction domains are collectively a nucleotide tag and a zinc finger domain and the nucleotide tag is a DNA tag or a dsDNA tag: or
   b) wherein the binding pair of biomolecular interaction domains are collectively a pair of nucleotide tags and the nucleotide tags are a DNA tags or a dsDNA tags.

6. The composition of claim 1, wherein the TCR recognition domain is allogeneic, autologous, or xenogenic to the engineered cell.

7. The composition of claim 1, wherein the TCR recognition domain is synthetic.

8. The composition of claim 1, wherein the TCR recognition domain comprises a MHC and a peptide, wherein the peptide is allogeneic, autologous, or xenogenic to the engineered cell.

9. The composition of claim 1, wherein the TCR recognition domain comprises a MHC and a peptide, wherein the peptide is synthetic.

10. The composition of claim 1, wherein the engineered cell is a NK cell, a dendritic cell, a regulatory T cell, or an effector T cell.

11. The composition of claim 1, wherein the engineered cell is further engineered to knockdown the native MHCI/II expressed on the cell surface.

12. The composition of claim 1, wherein the engineered cell is a NK cell.

13. The composition of claim 1, wherein the cell further comprises a TCR signaling-responsive promoter operatively linked to a payload transgene.

14. The composition of claim 13, wherein the TCR signaling-responsive promoter is a NFAT-sensitive promoter.

15. The composition of claim 13, wherein the payload transgene encodes a checkpoint inhibitor or a proinflammatory cytokine.

16. The composition of claim 15, wherein the checkpoint inhibitor is ipilimumab, tremelimumab, nivolumab, pembrolizumab, or pidilizumab.

17. The composition of claim 15, wherein the proinflammatory cytokine is IFN-γ, TNFα, TGF-β, IL-1β, IL-6, IL-4, IL-10, IL-13, IL-2, IL-12, IL-15, or IL-27.

* * * * *